United States Patent 11,098,302 (IDENTIFICATION OF POLYNUCLEOTIDES ASSOCIATED WITH A SAMPLE) - sequence listing, part 149

SEQ ID NO: 580240 - DNA, 511 bp, Homo sapiens
  misc_feature: HIJSMM301C2EMC.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacgaacggtaggaagtacaagacgaacgtagtggcgtgcgaccaatctcgtcttctactcttcccgt

SEQ ID NO: 580241 - DNA, 491 bp, Homo sapiens; identical to SEQ ID NO: 536211
  misc_feature: HIJSMM301C4E29.16.53.E09.1.454.light.4.raw

SEQ ID NO: 580242 - DNA, 487 bp, Homo sapiens; identical to SEQ ID NO: 536206
  misc_feature: HIJSMM301B7Z59.47.38.D05.1.454.light.4.raw

SEQ ID NO: 580243 - DNA, 480 bp, Homo sapiens; identical to SEQ ID NO: 535291
  misc_feature: HIJSMM301B4UEX.22.59.F04.1.454.light.4.raw

SEQ ID NO: 580244 - DNA, 497 bp, Homo sapiens
  misc_feature: HIJSMM301DL1P6.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgtaggctgaagatgtgcagtttattactgtcagcaatatttcgtgctccgtacacttttggccaggggacccaggtggagatcagacgaactgtggctgcaccatctgtcttcatcttcccgccta

SEQ ID NO: 580245 - DNA, 522 bp, Homo sapiens; identical to SEQ ID NO: 544405
  misc_feature: HIJSMM301AIUUE.27.23.C01.1.454.light.4.raw

SEQ ID NO: 580246 - DNA, 507 bp, Homo sapiens; identical to SEQ ID NO: 539817
  misc_feature: HIJSMM301AXK87.5.24.C02.1.454.light.4.raw

SEQ ID NO: 580247 - DNA, 501 bp, Homo sapiens
  misc_feature: HIJSMM301EVO0O.13.11.A11.1.454.light.4.raw
  modified_base (453)..(453): a, c, t, g, unknown or other
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggacgtccccagccgcttctctggatccaaggatgattccgccaacgcagggatattactcatctctgggctccagtctgacgatgaggctgacttattactgtttgacttggcacaacaacgcctggatcttcggacctggaccncgtcaccgtctaggtcagcccaaggcccaacccactgtcactctcgtt

SEQ ID NO: 580248 - DNA, 447 bp, Homo sapiens; identical to SEQ ID NO: 535201
  misc_feature: HIJSMM301EP8S2.18.9.A09.1.454.light.4.raw

SEQ ID NO: 580249 - DNA, 447 bp, Homo sapiens; identical to SEQ ID NO: 535020
  misc_feature: HIJSMM301CHGZJ.18.9.A09.1.454.light.4.raw

SEQ ID NO: 580250 - DNA, 497 bp, Homo sapiens; identical to SEQ ID NO: 536376
  misc_feature: HIJSMM301BXHTT.22.9.A09.1.454.light.4.raw

SEQ ID NO: 580251 - DNA, 492 bp, Homo sapiens; identical to SEQ ID NO: 538320
  misc_feature: HIJSMM301BGOKC.43.25.C03.1.454.light.4.raw

SEQ ID NO: 580252 - DNA, 504 bp, Homo sapiens
  misc_feature: HIJSMM301BQ0QT.40.33.C11.1.454.light.4.raw
tctagcgactcacgaccggtgctcgatttagagtgagctcgttgggtttgggggggaagcctgagaacacttagccttcatgagtgtccccaccatggcctggatgatgcttctcctcggactccttgcttatggatcaggagtggattctcagggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagcccaaggctgccccctc

SEQ ID NO: 580253 - DNA, 478 bp, Homo sapiens; identical to SEQ ID NO: 558143
  misc_feature: HIJSMM301C7WSZ.12.10.A10.1.454.light.4.raw

SEQ ID NO: 580254 - DNA, 520 bp, Homo sapiens; identical to SEQ ID NO: 539176
  misc_feature: HIJSMM301BKOUD.27.23.C01.1.454.light.4.raw

SEQ ID NO: 580255 - DNA, 520 bp, Homo sapiens; identical to SEQ ID NO: 537173
  misc_feature: HIJSMM301DYNNF.27.23.C01.1.454.light.4.raw

SEQ ID NO: 580256 - DNA, 482 bp, Homo sapiens
  misc_feature: HIJSMM301EZIRB.41.24.C02.1.454.light.4.raw
tctatactatcacgaccggtgctcgatttagtacagatcgttagggaaaggggctgggcctcaggaagcagcatcggaggtgcctcagccatggcatggatccctctcttcctcggcgtccttgcttactgcacaggatctgtggcctctttgagctgactcagccaccctcagtgtccgtgtccccaggacagacagccagcatcacctgctctggagataaattggggaataaatatgcttcctggtatcagcagaagccaggccagtcccctgtgctggtcatctatcaaagttcccagcggccctcagggatccctgagcgattctctggctccaattctgggaacacagccactctgaccatcagcgggacccaggctatcgatgaggctgagtattactgtcaggcgtgggacatcagcactgaggtggtattcggcggagggaccaagctgaccgtccttggtcagcccaaggcc

SEQ ID NO: 580257 - DNA, 492 bp, Homo sapiens; identical to SEQ ID NO: 534967
  misc_feature: HIJSMM301BJ6LP.47.64.F09.1.454.light.4.raw

SEQ ID NO: 580258 - DNA, 496 bp, Homo sapiens; identical to SEQ ID NO: 535109
  misc_feature: HIJSMM301D59K9.16.78.H01.1.454.light.4.raw

SEQ ID NO: 580259 - DNA, 497 bp, Homo sapiens; identical to SEQ ID NO: 535764
  misc_feature: HIJSMM301AFK1J.22.20.B09.1.454.light.4.raw

SEQ ID NO: 580260 - DNA, 502 bp, Homo sapiens
  misc_feature: HIJSMM301BN9G6.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaagtggatatcaacgaactgtggctgcaccatctgtctt

SEQ ID NO: 580261 - DNA, 489 bp, Homo sapiens
  misc_feature: HIJSMM301DIJP4.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctccattttcggcggagggaccaaggtgtagatcaaacgaactgtggctgcaccta

SEQ ID NO: 580262 - DNA, 465 bp, Homo sapiens; identical to SEQ ID NO: 542124
  misc_feature: HIJSMM301APQXF.48.59.F04.1.454.light.4.raw

SEQ ID NO: 580263 - DNA, 516 bp, Homo sapiens
  misc_feature: HIJSMM301ADLF4.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctcgttccccg

SEQ ID NO: 580264 - DNA, 461 bp, Homo sapiens
  misc_feature: HIJSMM301EZEDJ.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaacgaa

SEQ ID NO: 580265 - DNA, 492 bp, Homo sapiens; identical to SEQ ID NO: 564299
  misc_feature: HIJSMM301AXP8T.27.78.H01.1.454.light.4.raw

SEQ ID NO: 580266 - DNA, 445 bp, Homo sapiens; identical to SEQ ID NO: 537719
  misc_feature: HIJSMM301ANJ5X.47.85.H08.1.454.light.4.raw

SEQ ID NO: 580267 - DNA, 506 bp, Homo sapiens
  misc_feature: HIJSMM301EAK8P.48.81.H04.1.454.light.4.raw
agtatacatacacgaccggtgctcgatttagtagtgtagattcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccggtcggcggtcacgcccaaggctgccccctcggtcactctcgttcccaccct

SEQ ID NO: 580268 - DNA, 494 bp, Homo sapiens; identical to SEQ ID NO: 534992
  misc_feature: HIJSMM301EX07N.9.1.A01.1.454.light.4.raw

SEQ ID NO: 580269 - DNA, 491 bp, Homo sapiens; identical to SEQ ID NO: 535166
  misc_feature: HIJSMM301CHT27.47.78.H01.1.454.light.4.raw

SEQ ID NO: 580270 - DNA, 464 bp, Homo sapiens; identical to SEQ ID NO: 536640
  misc_feature: HIJSMM301D7W0V.26.78.H01.1.454.light.4.raw

SEQ ID NO: 580271 - DNA, 470 bp, Homo sapiens
  misc_feature: HIJSMM301C15V6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgatgccacgttttggcgggggaccaaggtggacatcaaacgaa

SEQ ID NO: 580272 - DNA, 502 bp, Homo sapiens; identical to SEQ ID NO: 552020
  misc_feature: HIJSMM301EKAWZ.49.82.H05.1.454.light.4.raw

SEQ ID NO: 580273 - DNA, 502 bp, Homo sapiens; identical to SEQ ID NO: 565460
  misc_feature: HIJSMM301D4XUS.12.48.E04.1.454.light.4.raw

SEQ ID NO: 580274 - DNA, 503 bp, Homo sapiens
  misc_feature: HIJSMM301AKRMC.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccgaacggtaggaaagtacaaacgaactagtggctgcaccatctgtcttctatt

SEQ ID NO: 580275 - DNA, 504 bp, Homo sapiens
  misc_feature: HIJSMM301CA8GI.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttaccctggacgttcggccaagggaccagggtaggaaatacaaacgaactagtggcgtgcaccatctgtcttcatcttcccccg

SEQ ID NO: 580276 - DNA, 510 bp, Homo sapiens
  misc_feature: HIJSMM301CEWE0.8.42.D09.1.454.light.4.raw
ctcgcgtgtccacgaccggtgctcgatttagacacatacgcaggggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactcctgttccccgcct

SEQ ID NO: 580277 - DNA, 491 bp, Homo sapiens
  misc_feature: HIJSMM301D4YGR.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgactgggttttattcactttcggccctgggaccaaagtggatttcagacgaactgtggctgcaccactctgtcttc

SEQ ID NO: 580278 - DNA, 509 bp, Homo sapiens; identical to SEQ ID NO: 543266
  misc_feature: HIJSMM301AOZ4T.17.33.C11.1.454.light.4.raw

SEQ ID NO: 580279 - DNA, 492 bp, Homo sapiens
  misc_feature: HIJSMM301A1HBQ.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcgcccagggaccacagtggatatcaggcgaactgtggctgcaccatctgtctt

SEQ ID NO: 580280 - DNA, 496 bp, Homo sapiens; identical to SEQ ID NO: 537225
  misc_feature: HIJSMM301AV1AO.11.59.F04.1.454.light.4.raw

SEQ ID NO: 580281 - DNA, 496 bp, Homo sapiens; identical to SEQ ID NO: 549072
  misc_feature: HIJSMM301BS7XF.22.14.B03.1.454.light.4.raw

SEQ ID NO: 580282 - DNA, 494 bp, Homo sapiens; identical to SEQ ID NO: 535680
  misc_feature: HIJSMM301DIDMY.16.78.H01.1.454.light.4.raw

SEQ ID NO: 580283 - DNA, 487 bp, Homo sapiens
  misc_feature: HIJSMM301EXIR8.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttatactgtcaacaatattatactactccgctcactttcggcggaggcaccaaggtggagatcagacgaactgtggctgca

SEQ ID NO: 580284 - DNA, 513 bp, Homo sapiens
  misc_feature: HIJSMM301BLKP5.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtccactctcgttcccgccctcct

SEQ ID NO: 580285 - DNA, 483 bp, Homo sapiens; identical to SEQ ID NO: 545413
  misc_feature: HIJSMM301EE2YR.16.81.H04.1.454.light.4.raw

SEQ ID NO: 580286 - DNA, 506 bp, Homo sapiens
  misc_feature: HIJSMM301E290C.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcggtgggacgagtcagcgagtggaggtggttttcgggttcggacggggaccggaacggaactcgaccgtcccgtaacgtacgtacgcccgaaccc

SEQ ID NO: 580287 - DNA, 501 bp, Homo sapiens
  misc_feature: HIJSMM301CFWRU.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaagtggagatcaaacgaactgtggctgcacca

SEQ ID NO: 580288 - DNA, 490 bp, Homo sapiens; identical to SEQ ID NO: 543909
  misc_feature: HIJSMM301BLM9J.14.55.E11.1.454.light.4.raw

SEQ ID NO: 580289 - DNA, 507 bp, Homo sapiens; identical to SEQ ID NO: 535930
  misc_feature: HIJSMM301A81JG.15.34.D01.1.454.light.4.raw

SEQ ID NO: 580290 - DNA, 485 bp, Homo sapiens; identical to SEQ ID NO: 535606
  misc_feature: HIJSMM301C17E5.47.46.E02.1.454.light.4.raw

SEQ ID NO: 580291 - DNA, 494 bp, Homo sapiens; identical to SEQ ID NO: 534992
  misc_feature: HIJSMM301A5BTP.9.1.A01.1.454.light.4.raw

SEQ ID NO: 580292 - DNA, 446 bp, Homo sapiens
  misc_feature: HIJSMM301D6LZU.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctcgccccctcggtcactctgttcccgcccttcctccgtgtctgat

SEQ ID NO: 580293 - DNA, 504 bp, Homo sapiens; identical to SEQ ID NO: 556255
  misc_feature: HIJSMM301DJC9T.48.26.C04.1.454.light.4.raw

SEQ ID NO: 580294 - DNA, 460 bp, Homo sapiens
  misc_feature: HIJSMM301EJ5W9.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcattctgttcccgccctcctcgtatctctcg

SEQ ID NO: 580295 - DNA, 507 bp, Homo sapiens
  misc_feature: HIJSMM301BXE1F.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaagctgcccctcggtcactctgtt

SEQ ID NO: 580296 - DNA, 494 bp, Homo sapiens; identical to SEQ ID NO: 576499
  misc_feature: HIJSMM301DUKZG.22.86.H09.1.454.light.4.raw

SEQ ID NO: 580297 - DNA, 487 bp, Homo sapiens; identical to SEQ ID NO: 536206
  misc_feature: HIJSMM301D5A3J.47.38.D05.1.454.light.4.raw

SEQ ID NO: 580298 - DNA, 503 bp, Homo sapiens
  misc_feature: HIJSMM301CT4VM.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactgtgctgcaccatctgtt

SEQ ID NO: 580299 - DNA, 480 bp, Homo sapiens; identical to SEQ ID NO: 535630
  misc_feature: HIJSMM301B6JW5.40.59.F04.1.454.light.4.raw

SEQ ID NO: 580300 - DNA, 444 bp, Homo sapiens; identical to SEQ ID NO: 535192
  misc_feature: HIJSMM301B9CSG.5.9.A09.1.454.light.4.raw

SEQ ID NO: 580301 - DNA, 502 bp, Homo sapiens; identical to SEQ ID NO: 554515
  misc_feature: HIJSMM301C5VST.4.71.G05.1.454.light.4.raw

SEQ ID NO: 580302 - DNA, 487 bp, Homo sapiens; identical to SEQ ID NO: 537573
  misc_feature: HIJSMM301A9AHU.3.10.A10.1.454.light.4.raw

SEQ ID NO: 580303 - DNA, 479 bp, Homo sapiens; identical to SEQ ID NO: 535665
  misc_feature: HIJSMM301EFLW0.12.10.A10.1.454.light.4.raw

SEQ ID NO: 580304 - DNA, 483 bp, Homo sapiens
  misc_feature: HIJSMM301ARB4D.51.41.D08.1.454.light.4.raw
cgatcgtatacacgaccggtgctcgatttagtcacgcgagaaagggaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtaccctgctcactttcggcggagggaccaaggtggagatcaaacgaactgtggctgcacc

SEQ ID NO: 580305 - DNA, 447 bp, Homo sapiens; identical to SEQ ID NO: 535020
  misc_feature: HIJSMM301ANWWX.18.9.A09.1.454.light.4.raw

SEQ ID NO: 580306 - DNA, 502 bp, Homo sapiens; identical to SEQ ID NO: 541971
  misc_feature: HIJSMM301EK5JF.4.39.D06.1.454.light.4.raw

SEQ ID NO: 580307 - DNA, 507 bp, Homo sapiens; identical to SEQ ID NO: 559118
  misc_feature: HIJSMM301EKBK2.17.87.H10.1.454.light.4.raw

SEQ ID NO: 580308 - DNA, 494 bp, Homo sapiens; identical to SEQ ID NO: 534992
  misc_feature: HIJSMM301BV1HV.9.1.A01.1.454.light.4.raw

SEQ ID NO: 580309 - DNA, 504 bp, Homo sapiens; identical to SEQ ID NO: 561069
  misc_feature: HIJSMM301E3EVV.19.78.H01.1.454.light.4.raw

SEQ ID NO: 580310 - DNA, 491 bp, Homo sapiens; identical to SEQ ID NO: 535194
  misc_feature: HIJSMM301DKE8M.26.78.H01.1.454.light.4.raw

SEQ ID NO: 580311 - DNA, 506 bp, Homo sapiens
  misc_feature: HIJSMM301CULJO.8.28.C06.1.454.light.4.raw
ctcgcgtgtccacgaccggtgctcgatttagagctcacgtattgggtttgggggaggaactgctcagttaggacccagacggaaccatggaagccccagcgaagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagttatttctgtcagcagtctgaagactggccgttcactttcggcggagggaccaaggtggacctcaaacgaactgtggctgcaccatctgtcttcatcttcccgccat

SEQ ID NO: 580312 - DNA, 488 bp, Homo sapiens
  misc_feature: HIJSMM301DW7KV.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattaattatacttcgtggacgttcggccaaggaccgaaggtggatatcagaacgaa

SEQ ID NO: 580313 - DNA, 473 bp, Homo sapiens
  misc_feature: HIJSMM301BLSD9.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggtccaagggaccaaggtggaaatcaaacgaa

SEQ ID NO: 580314 - DNA, 484 bp, Homo sapiens; identical to SEQ ID NO: 535400
  misc_feature: HIJSMM301C0UJD.46.26.C04.1.454.light.4.raw

SEQ ID NO: 580315 - DNA, 504 bp, Homo sapiens; identical to SEQ ID NO: 535935
  misc_feature: HIJSMM301BNM4V.18.78.H01.1.454.light.4.raw

SEQ ID NO: 580316 - DNA, 499 bp, Homo sapiens
  misc_feature: HIJSMM301AVJRG.41.82.H05.1.454.light.4.raw
tctatactatcacgaccggtgctcgatttagtcgagctctctcgcgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatatataaggcgtctagtttagaaagtggggtcccatcaaggatcagcggcagtggatctgggacagaattcactctcaccattagtagcctgcagcctgatgattttgcaacttattactgccaacaatataatgattttccgtggacgttcggccaagggaccaaggtagaaatcaaacgaactagtggctgcaccatctgtcttcatcttccccg

SEQ ID NO: 580317 - DNA, 502 bp, Homo sapiens; identical to SEQ ID NO: 543597
  misc_feature: HIJSMM301C2BB2.15.25.C03.1.454.light.4.raw

SEQ ID NO: 580318 - DNA, 485 bp, Homo sapiens; identical to SEQ ID NO: 570229
  misc_feature: HIJSMM301CZRBI.47.60.F05.1.454.light.4.raw

SEQ ID NO: 580319 - DNA, 475 bp, Homo sapiens; identical to SEQ ID NO: 551151
  misc_feature: HIJSMM301DCYJ2.13.76.G10.1.454.light.4.raw

SEQ ID NO: 580320 - DNA, 504 bp, Homo sapiens; identical to SEQ ID NO: 542411
  misc_feature: HIJSMM301BE1LU.9.53.E09.1.454.light.4.raw

SEQ ID NO: 580321 - DNA, 527 bp, Homo sapiens
  misc_feature: HIJSMM301BQJZP.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccgacggcgtcgaccgtccttaacgtactacgacccaacggacgtcgcccccgtcccc

SEQ ID NO: 580322 - DNA, 506 bp, Homo sapiens; identical to SEQ ID NO: 543993
  misc_feature: HIJSMM301BMTQZ.18.78.H01.1.454.light.4.raw

SEQ ID NO: 580323 - DNA, 496 bp, Homo sapiens
  misc_feature: HIJSMM301ERU3M.51.83.H06.1.454.light.4.raw
cgatcgtatacacgaccggtgctcgatttagatcacgtgcgtcgcgggggaggaacgtgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcat

SEQ ID NO: 580324 - DNA, 497 bp, Homo sapiens
  misc_feature: HIJSMM301A99EH.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacttcggtccaagggaccaaggtggagtatcagacgaactgtggctgc

SEQ ID NO: 580325 - DNA, 496 bp, Homo sapiens
  misc_feature: HIJSMM301DMU2G.3.78.H01.1.454.light.4.raw
agacgcactccacgaccggtgctcgatttagtgtgagtagtttgggtttggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctggcaccatctgtcttcta

SEQ ID NO: 580326 - DNA, 493 bp, Homo sapiens; identical to SEQ ID NO: 559886
  misc_feature: HIJSMM301BNMJ0.13.6.A06.1.454.light.4.raw

SEQ ID NO: 580327 - DNA, 479 bp, Homo sapiens; identical to SEQ ID NO: 535118
  misc_feature: HIJSMM301DSYJZ.13.59.F04.1.454.light.4.raw

SEQ ID NO: 580328 - DNA, 488 bp, Homo sapiens; identical to SEQ ID NO: 536554
  misc_feature: HIJSMM301BYGSH.26.37.D04.1.454.light.4.raw

SEQ ID NO: 580329 - DNA, 516 bp, Homo sapiens
  misc_feature: HIJSMM301A887U.9.14.B03.1.454.light.4.raw
  modified_base (436)..(436): a, c, t, g, unknown or other
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttattggtaccaacagaagtcaggccacggcccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagaggntgttcggcggagggaccaagctgaccgtcctaggtcagcccaaggctcgccccctggtcactctcgtcccaccctcctcg

SEQ ID NO: 580330 - DNA, 485 bp, Homo sapiens; identical to SEQ ID NO: 538954
  misc_feature: HIJSMM301CGIRJ.3.55.E11.1.454.light.4.raw

SEQ ID NO: 580331 - DNA, 491 bp, Homo sapiens
  misc_feature: HIJSMM301AEPEF.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttttactgtcagcagtatagtaactggcctccgtacactttggccaggggaccaagctagaaatcaaacgaactgtggctgcaccatctgtcttc

SEQ ID NO: 580332 - DNA, 506 bp, Homo sapiens
  misc_feature: HIJSMM301BISY0.48.57.F02.1.454.light.4.raw
agtatacatacacgaccggtgctcgatttagctcgatatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtccttcatccttccccg

SEQ ID NO: 580333 - DNA, 443 bp, Homo sapiens
  misc_feature: HIJSMM301BDHNV.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctcgtttcccgccctcctcgtatctctcg

SEQ ID NO: 580334 - DNA, 494 bp, Homo sapiens; identical to SEQ ID NO: 543247
  misc_feature: HIJSMM301A9ENY.22.57.F02.1.454.light.4.raw

SEQ ID NO: 580335 - DNA, 488 bp, Homo sapiens
  misc_feature: HIJSMM301BQH7H.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccacggctacggatgaggctgactattactgtcaggcgtgggacagcagcacctatgtggttttcggcggagggaccaagctgaccgtccttggtcagcccaaggctgcccccg

SEQ ID NO: 580336 - DNA, 499 bp, Homo sapiens
  misc_feature: HIJSMM301DKS1O.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggaggaccgaaggtagagatcaaaggaactagtggctgcaccatctgtcttctactcttccc

SEQ ID NO: 580337 - DNA, 516 bp, Homo sapiens
  misc_feature: HIJSMM301DAMLI.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtcggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgttcccccg

SEQ ID NO: 580338 - DNA, 504 bp, Homo sapiens
  misc_feature: HIJSMM301BSPTQ.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgtccccccg

SEQ ID NO: 580339 - DNA, 505 bp, Homo sapiens; identical to SEQ ID NO: 547532
  misc_feature: HIJSMM301A83GM.8.1.A01.1.454.light.4.raw

SEQ ID NO: 580340 - DNA, 448 bp, Homo sapiens; identical to SEQ ID NO: 540364
  misc_feature: HIJSMM301EDPSH.18.9.A09.1.454.light.4.raw

SEQ ID NO: 580341 - DNA, 493 bp, Homo sapiens; identical to SEQ ID NO: 538503
  misc_feature: HIJSMM301EL413.9.1.A01.1.454.light.4.raw

SEQ ID NO: 580342 - DNA, 457 bp, Homo sapiens; identical to SEQ ID NO: 536586
  misc_feature: HIJSMM301BIMUY.49.85.H08.1.454.light.4.raw

SEQ ID NO: 580343 - DNA, 478 bp, Homo sapiens; identical to SEQ ID NO: 535129
  misc_feature: HIJSMM301DJYBY.11.11.A11.1.454.light.4.raw

SEQ ID NO: 580344 - DNA, 484 bp, Homo sapiens
  misc_feature: HIJSMM301B9EW1.26.70.G04.1.454.light.4.raw
agactatactcacgaccggtgctcgatttagtgtagtgtgaagggaaaggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctaggaaactaacgaactgtggctgcacta

SEQ ID NO: 580345 - DNA, 493 bp, Homo sapiens
  misc_feature: HIJSMM301D8EIJ.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggtagggaccaaggtggagatcaaacgaactgtggctgcaccatctgtcttcatcttcccgccta

SEQ ID NO: 580346 - DNA, 492 bp, Homo sapiens; identical to SEQ ID NO: 535126
  misc_feature: HIJSMM301A65KG.18.11.A11.1.454.light.4.raw

SEQ ID NO: 580347 - DNA, 499 bp, Homo sapiens; identical to SEQ ID NO: 535899
  misc_feature: HIJSMM301EOUPP.19.78.H01.1.454.light.4.raw

SEQ ID NO: 580348 - DNA, 518 bp, Homo sapiens; identical to SEQ ID NO: 539372
  misc_feature: HIJSMM301DUSGS.7.86.H09.1.454.light.4.raw

SEQ ID NO: 580349 - DNA, 485 bp, Homo sapiens
  misc_feature: HIJSMM301BEWJ8.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtgggtcccatcaagttcagcggcagtggatctggcacagacttcattctcaccatcagcagcctgcagcctgaagtattttgctaacttattactgtctacaagatcacaattatcctgggacgttcggtccgaaggaccgaaggtaggaaatacgaaacgaactaggtgg

SEQ ID NO: 580350 - DNA, 488 bp, Homo sapiens; identical to SEQ ID NO: 579007
  misc_feature: HIJSMM301BD5JT.26.23.C01.1.454.light.4.raw

SEQ ID NO: 580351 - DNA, 441 bp, Homo sapiens; identical to SEQ ID NO: 534971
  misc_feature: HIJSMM301DY8TZ.11.3.A03.1.454.light.4.raw

SEQ ID NO: 580352 - DNA, 505 bp, Homo sapiens
  misc_feature: HIJSMM301AO3ZO.10.88.H11.1.454.light.4.raw
catagtagtgcacgaccggtgctcgatttagcgacagcgagaacacacaaagggggaggaactgctcagttaggacccagagggaaccatggaagcccagctcagcttctcttcctcctgctactctggctcccaggtaccaccggagagattgtgttgacgcagtcgccagccaccctgtctttttctccaggggacagagtcaccctctcctgtagggccagttatggtgttggcgcctattttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttatattgtcagcagcgtagcaggtggcctttcactttcggccgggaccaaagtggaaatcaaacgaactgtggctgcaccatctgtcttcgatcttcccgcc

SEQ ID NO: 580353 - DNA, 501 bp, Homo sapiens
  misc_feature: HIJSMM301BIMNO.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaagtggatatcaacgaactgtggctgcaccatctgtt

SEQ ID NO: 580354 - DNA, 519 bp, Homo sapiens
  misc_feature: HIJSMM301BGC3R.40.27.C05.1.454.light.4.raw
tctagcgactcacgaccggtgctcgatttagacgcgatcgaagggtttgggggggaagctcagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtctaggtcagcccaaggctgccccctcggt

SEQ ID NO: 580355 - DNA, 494 bp, Homo sapiens; identical to SEQ ID NO: 534994
  misc_feature: HIJSMM301BZK62.27.78.H01.1.454.light.4.raw

SEQ ID NO: 580356 - DNA, 507 bp, Homo sapiens; identical to SEQ ID NO: 535641
  misc_feature: HIJSMM301BUVDB.10.88.H11.1.454.light.4.raw

SEQ ID NO: 580357 - DNA, 494 bp, Homo sapiens; identical to SEQ ID NO: 534992
  misc_feature: HIJSMM301CZNR1.9.1.A01.1.454.light.4.raw

SEQ ID NO: 580358 - DNA, 496 bp, Homo sapiens
  misc_feature: HIJSMM301B8ZY6.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcgagggatctctgagcgattctctgcctcagctcagggacaacattcacattgaccatcagtgaagtccaggcagaagatgaggctgactattattgtcaatcaacagacagtaggtagggaaatatgtaggttagttcggcgggagggaccaaacgtcgaccgtctaggtcagacccaaggctccgtccccccg

SEQ ID NO: 580359 - DNA, 490 bp, Homo sapiens; identical to SEQ ID NO: 547085
  misc_feature: HIJSMM301BFED7.12.51.E07.1.454.light.4.raw

SEQ ID NO: 580360 - DNA, 490 bp, Homo sapiens
  misc_feature: HIJSMM301A6GXY.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgcat

SEQ ID NO: 580361 - DNA, 490 bp, Homo sapiens
  misc_feature: HIJSMM301A4SL3.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacacgttcccctcgctacttttggccgaggggaccaaagttgagatacaaacgaactgtggctgcaccatctgt

SEQ ID NO: 580362 - DNA, 484 bp, Homo sapiens
  misc_feature: HIJSMM301DV11I.51.11.A11.1.454.light.4.raw
  modified_base (478)..(478): a, c, t, g, unknown or other
cgatcgtatacacgaccggtgctcgatttagctacgactgcaggggagtcccaaccaggacacagcatggacatgagggtccctgctcagctcctggggctcctgctgctctaggctctcaggtgccagatgtgacatccagatgacccagtctccatcctccctgtctgcatctgtaggagacagagtcaccatcacttgccaggcgagtcaggacattagcaactatttaaattggtatcagcagaaaccagggaaagcccctaaactcctgatctacgatgcatccaatttggaaacaggggtcccatcaaggttcagtggaagtggttctgggacagattttacttcaccatcagcagccttcaccctgaagatcttgcaacatattactgtcaacagtatgataatctcccactcactttcggcggagggaccaaaggtggagatcaaacgaactgtggctgcaccatctgtnttccta

SEQ ID NO: 580363 - DNA, 520 bp, Homo sapiens; identical to SEQ ID NO: 539176
  misc_feature: HIJSMM301A1Y4N.27.23.C01.1.454.light.4.raw

SEQ ID NO: 580364 - DNA, 504 bp, Homo sapiens; identical to SEQ ID NO: 535709
  misc_feature: HIJSMM301BRZLW.9.55.E11.1.454.light.4.raw

SEQ ID NO: 580365 - DNA, 517 bp, Homo sapiens
  misc_feature: HIJSMM301BHATH.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgtttcggcgggagggaccaagctgaccgtcctaagtcagcccagggctgccccctcggtcactctgttcccaccctcctcg

SEQ ID NO: 580366 - DNA, 486 bp, Homo sapiens
  misc_feature: HIJSMM301DHRE5.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtcacgtcccaagaacttttggccaggggccaagctggagatcaaacgaactgtggctgcaccat

SEQ ID NO: 580367 - DNA, 505 bp, Homo sapiens; identical to SEQ ID NO: 535503
  misc_feature: HIJSMM301CTQ20.8.28.C06.1.454.light.4.raw

SEQ ID NO: 580368 - DNA, 495 bp, Homo sapiens
  misc_feature: HIJSMM301BSLAD.16.46.E02.1.454.light.4.raw
tgtactactccacgaccggtgctcgatttagactcatctacagggaaaggggctgtgcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttggaactgggaccaaggtcaccgtcctaggtcagcccaaggccaaccccactgtcactctgttcccaccctcctcgagtagtca

SEQ ID NO: 580369 - DNA, 484 bp, Homo sapiens; identical to SEQ ID NO: 535400
  misc_feature: HIJSMM301AIZ7D.46.26.C04.1.454.light.4.raw

SEQ ID NO: 580370 - DNA, 464 bp, Homo sapiens
  misc_feature: HIJSMM301AY4QC.52.28.C06.1.454.light.4.raw
cgcagtacgacacgaccggtgctcgatttagagctcacgtattgggtttgggctacactagaagaacagtatttggtatctgcgctctgctgaagccagttacctcggaaaagagttggtagctcttgatccggcaaacaaaccaccgctggtagcggtggtttttttgttgcaagcagcagattacgcgcagaaaaaaggatctcaagaagatcctttgattttctaccgaagaaaggcccacccgtgtaaaacgacggccagtttatctagtcagcttgattctagctgatcgtggaccggaaggtgagccagtgagttgattgcagtccagttacgctggagtctgaggctcgtcctgaatgatatgcggcctctaagcttactgactaggccggccttaattaggtcagcctaaggctgcccccagcgtcactctgttcccgccctcctctatacgatcg

SEQ ID NO: 580371 - DNA, 478 bp, Homo sapiens
  misc_feature: HIJSMM301C2ORG.52.40.D07.1.454.light.4.raw
cgcagtacgacacgaccggtgctcgatttagtgatagagcgtaacaacagaggggagtcccagtcaggacacagcatggacatgagggtccccgctcagctcctggggctcctgctgctctggctcccaggtgccagatgtgacatccagttgacccagtctccatccttcctatctgcatctgtaggagacagagtcaccatcacttgtcgggcgagtcagggtattagcagctggttagcctggtatcagcagaaaccagggaaagcccctaagctcctgatctatgctgcatccactttgcagagtggggtcccatcaaggttcagcggcagtggatctgggagacaattcactctcacaatcagcagcctgcagcctgaagattttgcgacttattactgtcaacaacttaatcgttaccctcttttcggccctgggaccaaagtggatatcaaacgaactgtggctgcaccat

SEQ ID NO: 580372 - DNA, 520 bp, Homo sapiens; identical to SEQ ID NO: 537173
  misc_feature: HIJSMM301DNK74.27.23.C01.1.454.light.4.raw

SEQ ID NO: 580373 - DNA, 496 bp, Homo sapiens
  misc_feature: HIJSMM301A3H8X.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagatttgcagtgtattattgtcagcaatatggtaggtcacctgggacttttggccagggggaccaagctggaggatcaaacgaactgtggctgcaccatctgtctt

SEQ ID NO: 580374 - DNA, 513 bp, Homo sapiens
  misc_feature: HIJSMM301DHWQ4.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggcccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtccagcccaaggccaaccccactgtcactctcgttcccaccct

SEQ ID NO: 580375 - DNA, 506 bp, Homo sapiens
  misc_feature: HIJSMM301AKEFY.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatacaaacgaactagtggctgcaccatactgtcttcatcttccccg

SEQ ID NO: 580376 - DNA, 508 bp, Homo sapiens; identical to SEQ ID NO: 536062
  misc_feature: HIJSMM301CMTID.11.57.F02.1.454.light.4.raw

SEQ ID NO: 580377 - DNA, 503 bp, Homo sapiens; identical to SEQ ID NO: 547798
  misc_feature: HIJSMM301A83ZJ.21.22.B11.1.454.light.4.raw

SEQ ID NO: 580378 - DNA, 506 bp, Homo sapiens
  misc_feature: HIJSMM301DH4W4.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcccgtgggaccaaagtggatatcaaacgaactgtggctgcaccatctgtctt

SEQ ID NO: 580379 - DNA, 497 bp, Homo sapiens; identical to SEQ ID NO: 536376
  misc_feature: HIJSMM301AY1W5.22.9.A09.1.454.light.4.raw

SEQ ID NO: 580380 - DNA, 493 bp, Homo sapiens; identical to SEQ ID NO: 536246
  misc_feature: HIJSMM301B68EI.49.66.F11.1.454.light.4.raw

SEQ ID NO: 580381 - DNA, 494 bp, Homo sapiens
  misc_feature: HIJSMM301EMXU3.51.30.C08.1.454.light.4.raw
cgatcgtatacacgaccggtgctcgatttagtctgacgtcaaagggaaaggggactgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgca

SEQ ID NO: 580382 - DNA, 493 bp, Homo sapiens
  misc_feature: HIJSMM301BRF5J.48.44.D11.1.454.light.4.raw
  modified_base (228)..(228): a, c, t, g, unknown or other
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcggagggccacgatacgaactgcaagtccagccagagtattttanacagctcctacaataagagcgacttagcttggtaccagcagaaaccaggacagcctcctaagttgctcatttactgggcatctaaccggcaatccggggtcctgaccgattcagtggcagcgggtctgggacacatttcgctttcaccatcagcagcctgcaggctgaggatgtggcagtttatactgtcagcaatattatactactccggtggactttcggccaagggaccaaggtggaaatcagacgaactcgtggctgcacc

SEQ ID NO: 580383 - DNA, 496 bp, Homo sapiens; identical to SEQ ID NO: 535109
  misc_feature: HIJSMM301DCCLL.16.78.H01.1.454.light.4.raw

SEQ ID NO: 580384 - DNA, 495 bp, Homo sapiens
  misc_feature: HIJSMM301AVQ2H.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgctttaacagtatcataatctccccactttcggtccctcgggaccgaaacgtaggatatacaaacgaactagtggctgcaccatctgtt

SEQ ID NO: 580385 - DNA, 522 bp, Homo sapiens; identical to SEQ ID NO: 539966
  misc_feature: HIJSMM301ALS29.27.23.C01.1.454.light.4.raw

SEQ ID NO: 580386 - DNA, 503 bp, Homo sapiens
  misc_feature: HIJSMM301A5LCX.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatgggatgaacaatctgagcggttgggtgttcggcggagggaccaaactgaccgtcctaggtcagcccaa

SEQ ID NO: 580387 - DNA, 444 bp, Homo sapiens; identical to SEQ ID NO: 535192
  misc_feature: HIJSMM301AKD81.5.9.A09.1.454.light.4.raw

SEQ ID NO: 580388 - DNA, 494 bp, Homo sapiens
  misc_feature: HIJSMM301EMOZ9.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaacttatttttgtctaacaggcttaacactttcccccctcaccttttcggcggagggaccaaggtggagatcaagcgaactgtggctgcaccat

SEQ ID NO: 580389 - DNA, 520 bp, Homo sapiens; identical to SEQ ID NO: 540293
  misc_feature: HIJSMM301B7GT6.27.23.C01.1.454.light.4.raw

SEQ ID NO: 580390 - DNA, 521 bp, Homo sapiens; identical to SEQ ID NO: 538715
  misc_feature: HIJSMM301BWXR2.27.23.C01.1.454.light.4.raw

SEQ ID NO: 580391 - DNA, 503 bp, Homo sapiens; identical to SEQ ID NO: 536834
  misc_feature: HIJSMM301CVYMS.2.35.D02.1.454.light.4.raw

SEQ ID NO: 580392 - DNA, 479 bp, Homo sapiens; identical to SEQ ID NO: 553343
  misc_feature: HIJSMM301AX21S.43.12.B01.1.454.light.4.raw

SEQ ID NO: 580393 - DNA, 497 bp, Homo sapiens; identical to SEQ ID NO: 535286
  misc_feature: HIJSMM301ATBII.18.59.F04.1.454.light.4.raw

SEQ ID NO: 580394 - DNA, 503 bp, Homo sapiens; identical to SEQ ID NO: 547049
  misc_feature: HIJSMM301ERZ4J.18.59.F04.1.454.light.4.raw

SEQ ID NO: 580395 - DNA, 496 bp, Homo sapiens; identical to SEQ ID NO: 535843
  misc_feature: HIJSMM301AXAUL.3.71.G05.1.454.light.4.raw

SEQ ID NO: 580396 - DNA, 486 bp, Homo sapiens; identical to SEQ ID NO: 537583
  misc_feature: HIJSMM301EP79S.17.25.C03.1.454.light.4.raw

SEQ ID NO: 580397 - DNA, 445 bp, Homo sapiens; identical to SEQ ID NO: 536433
  misc_feature: HIJSMM301CHELA.5.9.A09.1.454.light.4.raw

SEQ ID NO: 580398 - DNA, 490 bp, Homo sapiens; identical to SEQ ID NO: 541567
  misc_feature: HIJSMM301BVNL2.22.65.F10.1.454.light.4.raw

SEQ ID NO: 580399 - DNA, 497 bp, Homo sapiens; identical to SEQ ID NO: 544674
  misc_feature: HIJSMM301DRKR6.40.59.F04.1.454.light.4.raw

SEQ ID NO: 580400 - DNA, 491 bp, Homo sapiens; identical to SEQ ID NO: 535294
  misc_feature: HIJSMM301AVTVR.16.68.G02.1.454.light.4.raw

SEQ ID NO: 580401 - DNA, 504 bp, Homo sapiens
  misc_feature: HIJSMM301C1TQ8.21.46.E02.1.454.light.4.raw
tcgtcgctcgcacgaccggtgctcgatttagactcatctacagggaaagggggtgggtccaggaggcagaactctgggtgtctcaccatggcctggatccctctacttcctccccctcctcactctctgcacaggctctgaggcctcctatgagctgacacagcccaccctcggtgtcagtgtccccaggacagacggccaggatcacctgctctgcagatggactgccaaagaaatatgcttattggtaccaacagaagccaggccaggcccctgtgttagtgatatataaagacactgagaggccctcagagatccctgagcgattctctggctccagctcagggacagcagtcacgttgactatcagtgaagtccaggcagaggacgaggctgactattactgtcaaacagtaagacagtagaggtactcattggggtgttcggcgggacgggaccaagctggacccgtcgtaacggtcacgcccaaggctcgccccctcc

SEQ ID NO: 580402 - DNA, 385 bp, Homo sapiens
  misc_feature: HIJSMM301ALBAG.48.37.D04.1.454.light.4.raw
agtatacatacacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 580403 - DNA, 372 bp, Homo sapiens
  misc_feature: HIJSMM301AYAMX.9.11.A11.1.454.light.4.raw
tgatacgtctcacgaccggtgctcgatttagctacgactgcaggggagagagccaccctctcttgcaggaccagtctgcatattcccagcacctacgtagcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccgccatctgaagacgtatca

SEQ ID NO: 580404 - DNA, 521 bp, Homo sapiens; identical to SEQ ID NO: 562813
  misc_feature: HIJSMM301BCO4H.10.86.H09.1.454.light.4.raw

SEQ ID NO: 580405 - DNA, 508 bp, Homo sapiens
  misc_feature: HIJSMM301AMWBX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtaggaaatacaaacgaactagtggctgcaccatctgtcttctatcttccccg

SEQ ID NO: 580406 - DNA, 496 bp, Homo sapiens; identical to SEQ ID NO: 542375
  misc_feature: HIJSMM301C64FJ.7.59.F04.1.454.light.4.raw

SEQ ID NO: 580407 - DNA, 496 bp, Homo sapiens
  misc_feature: HIJSMM301ADJZH.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggaggatcaaacgaactgtggctgcaccatctgtctt

SEQ ID NO: 580408 - DNA, 491 bp, Homo sapiens; identical to SEQ ID NO: 536549
  misc_feature: HIJSMM301A8PYN.47.55.E11.1.454.light.4.raw

SEQ ID NO: 580409 - DNA, 500 bp, Homo sapiens
  misc_feature: HIJSMM301CX6MM.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccagactcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 580410 - DNA, 502 bp, Homo sapiens; identical to SEQ ID NO: 560287
  misc_feature: HIJSMM301C3A0N.10.71.G05.1.454.light.4.raw

SEQ ID NO: 580411 - DNA, 504 bp, Homo sapiens
  misc_feature: HIJSMM301CAUDX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaaggaccgaaggtggaaatacaaacgaactagtggctgcaccatctgtcttctatcttccccg

SEQ ID NO: 580412 - DNA, 520 bp, Homo sapiens
  misc_feature: HIJSMM301D7R9X.9.38.D05.1.454.light.4.raw
  modified_base (516)..(516): a, c, t, g, unknown or other
tgatacgtctcacgaccggtgctcgatttagtatctgatagttgggtttgggggctggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagagtagccctctcgtggttttcggcgggggaccgaaggtgaccgtcctaagtcagcccaaggctgccccctcggtcactctgttcccnccct

SEQ ID NO: 580413 - DNA, 495 bp, Homo sapiens; identical to SEQ ID NO: 576602
  misc_feature: HIJSMM301CXPZT.9.1.A01.1.454.light.4.raw

SEQ ID NO: 580414 - DNA, 501 bp, Homo sapiens
  misc_feature: HIJSMM301D7OBY.52.51.E07.1.454.light.4.raw
cgcagtacgacacgaccggtgctcgatttagcatactctacaacacacaaagggggagctacaacaggcaggcaggggcagcaagatggtgttgcagacccaggtcttcatttctctgttgctctggatctctggtgtctacggggacttcgtgctgacccagtctccagactccctggctgtgtctctgggcgcgagggccaccatcaactgcaagtccagccggagtgttttctggcgcccccaccgataagaactacttagcttggtatcagcacaaaccaggacaccctcccaaactcctcatttcctgggcatctacccgggaatccggggtccctgaccgattcagtggcagcgggtctgagacggatttcactctcaccatcagcagcctgcaggctgaagatgtggcagtgtattactgtcagcagtatgctggtactccctacacttttggccaggggaccaagggtggagatcaaacgaactgtggctgca

SEQ ID NO: 580415 - DNA, 484 bp, Homo sapiens; identical to SEQ ID NO: 535400
  misc_feature: HIJSMM301DQTHL.46.26.C04.1.454.light.4.raw

SEQ ID NO: 580416 - DNA, 487 bp, Homo sapiens
  misc_feature: HIJSMM301EO4PU.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtcctgacaggttcagtggcagtggatcaggcacagattttacgctgaaaatcagtagggtggaggctgaggatgttggggtttattactgcatgcaagttctacaaacttcctacacttttggccaggggaccaagctggagatcaaaacgaa

SEQ ID NO: 580417 - DNA, 483 bp, Homo sapiens; identical to SEQ ID NO: 555750
  misc_feature: HIJSMM301EJGR6.41.78.H01.1.454.light.4.raw

SEQ ID NO: 580418 - DNA, 496 bp, Homo sapiens
  misc_feature: HIJSMM301DXLC2.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtgggcccatcaaggttcagtggcagtggctctgggacagatttcactctcaccatcagcagtctccaacctgaagattttgcaacttactactgtcaacagagtttcagtagtcccccggacgttcggccgaacggaccaaggtaggacgatacaaacgaactagtggctgcaccactctgtctt

SEQ ID NO: 580419 - DNA, 486 bp, Homo sapiens; identical to SEQ ID NO: 537310
  misc_feature: HIJSMM301CPXY3.15.28.C06.1.454.light.4.raw

SEQ ID NO: 580420 - DNA, 517 bp, Homo sapiens
  misc_feature: HIJSMM301AMPWE.12.85.H08.1.454.light.4.raw
atacgacgtacacgaccggtgctcgatttagtatcactcagtcgcggggggggtcgtcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttcccg

SEQ ID NO: 580421 - DNA, 499 bp, Homo sapiens; identical to SEQ ID NO: 550763
  misc_feature: HIJSMM301DSDJV.19.78.H01.1.454.light.4.raw

SEQ ID NO: 580422 - DNA, 485 bp, Homo sapiens; identical to SEQ ID NO: 536040
  misc_feature: HIJSMM301AUJNP.15.1.A01.1.454.light.4.raw

SEQ ID NO: 580423 - DNA, 508 bp, Homo sapiens
  misc_feature: HIJSMM301AWT3P.53.21.B10.1.454.light.4.raw
cgcgtatacacacgaccggtgctcgatttagtgtcgtcgcaaggagaggagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagccaaggctcgccccctcggtcactctgtt

SEQ ID NO: 580424 - DNA, 482 bp, Homo sapiens; identical to SEQ ID NO: 578552
  misc_feature: HIJSMM301AKBGF.40.83.H06.1.454.light.4.raw

SEQ ID NO: 580425 - DNA, 510 bp, Homo sapiens
  misc_feature: HIJSMM301B2QLE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtacggaaatacaaacgaactagtaggctgcgaccatctgtcttctactcttccccg

SEQ ID NO: 580426 - DNA, 490 bp, Homo sapiens
  misc_feature: HIJSMM301CEOB3.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaatggagtcccatcaagattcagcggcagtggatctggcacagctttcactctcaccgtcagcagcctgcagtctgaagattttgcaacttattactgtctacaagattcttcttaccctcggacgttcggtccgagggaccgacggtcggagtgtcaacgacgaactcgtggcgtgcgaccat

SEQ ID NO: 580427 - DNA, 498 bp, Homo sapiens
  misc_feature: HIJSMM301CQ527.40.23.C01.1.454.light.4.raw
tctagcgactcacgaccggtgctcgatttagtacacgtgattagggattggggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatt

SEQ ID NO: 580428 - DNA, 504 bp, Homo sapiens; identical to SEQ ID NO: 551974
  misc_feature: HIJSMM301DFKTY.19.78.H01.1.454.light.4.raw

SEQ ID NO: 580429 - DNA, 497 bp, Homo sapiens
  misc_feature: HIJSMM301D9XKV.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttccccg

SEQ ID NO: 580430 - DNA, 485 bp, Homo sapiens; identical to SEQ ID NO: 536263
  misc_feature: HIJSMM301AQDL2.47.78.H01.1.454.light.4.raw

SEQ ID NO: 580431 - DNA, 481 bp, Homo sapiens; identical to SEQ ID NO: 535993
  misc_feature: HIJSMM301BQVZJ.21.25.C03.1.454.light.4.raw

SEQ ID NO: 580432 - DNA, 501 bp, Homo sapiens
  misc_feature: HIJSMM301DUTFE.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccactctcgtctctcttccttccccg

SEQ ID NO: 580433 - DNA, 504 bp, Homo sapiens; identical to SEQ ID NO: 551974
  misc_feature: HIJSMM301CUB88.19.78.H01.1.454.light.4.raw

SEQ ID NO: 580434 - DNA, 486 bp, Homo sapiens; identical to SEQ ID NO: 535043
  misc_feature: HIJSMM301ELSQ3.46.35.D02.1.454.light.4.raw

SEQ ID NO: 580435 - DNA, 493 bp, Homo sapiens; identical to SEQ ID NO: 535745
  misc_feature: HIJSMM301DJ2V9.47.78.H01.1.454.light.4.raw

SEQ ID NO: 580436 - DNA, 477 bp, Homo sapiens
  misc_feature: HIJSMM301C7J9M.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggcaagggaccaaggtggaaatcaaacgaaactgtggctgcaccat

SEQ ID NO: 580437 - DNA, 486 bp, Homo sapiens; identical to SEQ ID NO: 535043
  misc_feature: HIJSMM301D0S78.46.35.D02.1.454.light.4.raw

SEQ ID NO: 580438 - DNA, 493 bp, Homo sapiens; identical to SEQ ID NO: 556456
  misc_feature: HIJSMM301B6B79.49.41.D08.1.454.light.4.raw

SEQ ID NO: 580439 - DNA, 535 bp, Homo sapiens
  misc_feature: HIJSMM301B5F4N.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcccgtccggcgacgttcggaccgaacgggaccgaaggtaggaagtacgaagacgaacgtggtggcgtcgcaccactctcgttcttctactccctcccgcccacttcg

SEQ ID NO: 580440 - DNA, 502 bp, Homo sapiens
  misc_feature: HIJSMM301BW9YZ.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggctgccccctcggtc

SEQ ID NO: 580441 - DNA, 518 bp, Homo sapiens; identical to SEQ ID NO: 559454
  misc_feature: HIJSMM301CZ2OE.47.53.E09.1.454.light.4.raw

SEQ ID NO: 580442 - DNA, 501 bp, Homo sapiens
  misc_feature: HIJSMM301CK3HL.52.87.H10.1.454.light.4.raw
  modified_base (199)..(199): a, c, t, g, unknown or other
cgcagtacgacacgaccggtgctcgatttagcagtactgcgttgggtttgggggaggaactgctcagttaggacccagagggaaccatggaagccccagctcagcttctcttcctcctgctactctggctcccagataccaccggagaagttgtattgacacagtctccagccaccctgtctttgtctccagggggganagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 580443 - DNA, 498 bp, Homo sapiens
  misc_feature: HIJSMM301BTQ1U.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcgcggagggaccgagctgaccgtcctacgtcagcccaaggctcg

SEQ ID NO: 580444 - DNA, 489 bp, Homo sapiens
  misc_feature: HIJSMM301A2FPK.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttcggccaggggacacgactggagattaaacgaactgtggctgcaccat

SEQ ID NO: 580445 - DNA, 495 bp, Homo sapiens; identical to SEQ ID NO: 543094
  misc_feature: HIJSMM301BGYIU.22.57.F02.1.454.light.4.raw

SEQ ID NO: 580446 - DNA, 445 bp, Homo sapiens
  misc_feature: HIJSMM301DBCFU.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcacgtcctaagtcagccaaggccaacccctctgtcactctgttcccaccctcctccatactcgta

SEQ ID NO: 580447 - DNA, 484 bp, Homo sapiens; identical to SEQ ID NO: 535400
  misc_feature: HIJSMM301AY6P0.46.26.C04.1.454.light.4.raw

SEQ ID NO: 580448 - DNA, 445 bp, Homo sapiens
  misc_feature: HIJSMM301EVL7Y.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcgggcggagggaccaagctgaccgtcctaggtcagcccaaggctgccccctcggtcactctgttcccaccctcctcagacgtatca

SEQ ID NO: 580449 - DNA, 488 bp, Homo sapiens; identical to SEQ ID NO: 535990
  misc_feature: HIJSMM301ATI15.11.28.C06.1.454.light.4.raw

SEQ ID NO: 580450 - DNA, 446 bp, Homo sapiens
  misc_feature: HIJSMM301CHSQL.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttccccgccctcctctacgtgagct

SEQ ID NO: 580451 - DNA, 504 bp, Homo sapiens; identical to SEQ ID NO: 535561
  misc_feature: HIJSMM301EDQEP.4.57.F02.1.454.light.4.raw

SEQ ID NO: 580452 - DNA, 507 bp, Homo sapiens
  misc_feature: HIJSMM301C3CVW.12.55.E11.1.454.light.4.raw
atacgacgtacacgaccggtgctcgatttagcactcgcacgttgggtttgggggtggtagctcaggaagcagagcctggagcatctccactatggcctgggctccactacttctcaccctcctcgctcactgcacaggttcttgggccagcttttgctgactcagccccactctgtgtcggggtctccggggaagacggtaaccatctcctgcaccggcagcagtggcaacattgccacgaagtatgtgcagtggtaccagcagcgcccgggcagtgcccccaccactataatctatgaggatgaccgacgaccctctggggtccctgatcgtttctctggctccatcgacagctcctccaattctgcctccctcaccatctctggactcatgtctgaggacgaggctgactactactgtcagtcttatgataatacgcttgttttttcggtcggtcgggaccaagctgaccgtcctaggtcagcccaaggctgccccctcggtcta

SEQ ID NO: 580453 - DNA, 494 bp, Homo sapiens; identical to SEQ ID NO: 534992
  misc_feature: HIJSMM301C9XZP.9.1.A01.1.454.light.4.raw

SEQ ID NO: 580454 - DNA, 499 bp, Homo sapiens
  misc_feature: HIJSMM301B5U8P.48.86.H09.1.454.light.4.raw
agtatacatacacgaccggtgctcgatttagtgctatagacttgggtttggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 580455 - DNA, 505 bp, Homo sapiens
  misc_feature: HIJSMM301B086V.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggcaccctgaccatcagcagggtcgaagccgggatgaggccgactattactgtcaggtgtgggatagtagtggtgatcatccatacgtcttcggaactgggaccaaggtctccgtctacgtcagcccaaggccaatccactgtcactctgttccccg

SEQ ID NO: 580456 - DNA, 483 bp, Homo sapiens; identical to SEQ ID NO: 535413
  misc_feature: HIJSMM301AJLC9.26.78.H01.1.454.light.4.raw

SEQ ID NO: 580457 - DNA, 497 bp, Homo sapiens
  misc_feature: HIJSMM301BSTZA.3.31.C09.1.454.light.4.raw
  modified_base (387)..(387): a, c, t, g, unknown or other
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagggancctgaagattttgcagtttattactgtcagcagcgtagcaactggcctctcactttcggcggagggaccaaggtggagatcaaacgaactgtggctgcaccatctgtctt

SEQ ID NO: 580458 - DNA, 507 bp, Homo sapiens
  misc_feature: HIJSMM301BST6D.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttgccgaaggaccgaaggtggaaagtacaaacgaacctagtggctcgcaccaatctgtcttcatcttccccg

SEQ ID NO: 580459 - DNA, 515 bp, Homo sapiens
  misc_feature: HIJSMM301CII1E.16.83.H06.1.454.light.4.raw
  modified_base (440)..(440): a, c, t, g, unknown or other
  modified_base (447)..(447): a, c, t, g, unknown or other
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgttcaggtgtgggatagtagtagtgatcatatgtnttcgtantggacgaggtcgacgtcctagtcgagaccacggccaacccacctaccgctactcctgttcctaccctt

SEQ ID NO: 580460 - DNA, 483 bp, Homo sapiens
  misc_feature: HIJSMM301CPAC1.48.34.D01.1.454.light.4.raw
  modified_base (434)..(434): a, c, t, g, unknown or other
  modified_base (474)..(474): a, c, t, g, unknown or other
agtatacatacacgaccggtgctcgatttagatcgtctgtgttgggtttggggaaccatggaagccccagcgcagcttctcttcctcctgctactctggctcccagaaagcaccggagacattgaactgacgcagtctccaggcaccctgtctttgtctccaggggaaagagccaccctctcctgcagggccggtcggagtctttccagcacctacttagcctggtaccaacaaaagctggccaggctcccaggctcctcatatatgatgtttctaccagggccactggcattccagacaggttcagtggcagtgggtctgggacagacttcactctcaccatcaacagattggagcctgaagactctgcagtctatttctgtcagcaatatcgcagttcagtctcgtacactttggtcgacgggacgaccgcngtaggatacaacgaaacctagtggtcgtgcaccaactctntcttcttac

SEQ ID NO: 580461 - DNA, 509 bp, Homo sapiens
  misc_feature: HIJSMM301C3ORZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgcacggacgaacggtaggaagtacaaacgaaactagtaggcgtgcgaccactctgtcttctactcttccccg

SEQ ID NO: 580462 - DNA, 492 bp, Homo sapiens; identical to SEQ ID NO: 545637
  misc_feature: HIJSMM301B55NV.48.1.A01.1.454.light.4.raw

SEQ ID NO: 580463 - DNA, 509 bp, Homo sapiens
  misc_feature: HIJSMM301BNJO7.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtgggggttcaatattggaggtaacaatgtgcactggtaccagcagaaggcagggcaggcccctgtactggtcatctatggggatccatccggccaggtgggacccctgcgcgattctctgcctccatctcggggaacgcggccaccctgaccatcagcaaagcccaagccggtgatgaggctgactattttgtcaggtgtgggacagcagcatttatgtcttcggacctgggaccaaggtcaccgtcctaggtcagcccaaggccaacccactgtcactctgttcccaccctctcga

SEQ ID NO: 580464 - DNA, 504 bp, Homo sapiens; identical to SEQ ID NO: 535077
  misc_feature: HIJSMM301BJIO1.8.28.C06.1.454.light.4.raw

SEQ ID NO: 580465 - DNA, 504 bp, Homo sapiens
  misc_feature: HIJSMM301CQ09N.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagccaaggctgccccctcggtcactctgtt

SEQ ID NO: 580466 - DNA, 521 bp, Homo sapiens; identical to SEQ ID NO: 536990
  misc_feature: HIJSMM301DHEM9.27.23.C01.1.454.light.4.raw
  modified_base (517)..(517): a, c, t, g, unknown or other

SEQ ID NO: 580467 - DNA, 486 bp, Homo sapiens; identical to SEQ ID NO: 535385
  misc_feature: HIJSMM301DKOVO.19.71.G05.1.454.light.4.raw

SEQ ID NO: 580468 - DNA, 498 bp, Homo sapiens
  misc_feature: HIJSMM301CY8HH.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaaggctggagatcagacgaactgtggctgcaccatctgtcttcatcttccccg

SEQ ID NO: 580469 - DNA, 489 bp, Homo sapiens; identical to SEQ ID NO: 546040
  misc_feature: HIJSMM301DDDA7.11.12.B01.1.454.light.4.raw

SEQ ID NO: 580470 - DNA, 493 bp, Homo sapiens
  misc_feature: HIJSMM301DS51R.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacatggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggaggatcaaacgaactgtggctgcaccatctgtcttcta

SEQ ID NO: 580471 - DNA, 514 bp, Homo sapiens; identical to SEQ ID NO: 559713
  misc_feature: HIJSMM301C1RNU.8.23.C01.1.454.light.4.raw

SEQ ID NO: 580472 - DNA, 477 bp, Homo sapiens
  misc_feature: HIJSMM301CIX1Q.26.72.G06.1.454.light.4.raw
  modified_base (348)..(348): a, c, t, g, unknown or other
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagngatttttgtaaggggaaagtaatgaagttaacactgtggatcaccttcggccaagggacacgactggagattaaacgaactgtggctgcaccatctgtcttcatcttcccgccatctgaagtatagtct

SEQ ID NO: 580473 - DNA, 493 bp, Homo sapiens; identical to SEQ ID NO: 536246
  misc_feature: HIJSMM301BQYT1.49.66.F11.1.454.light.4.raw

SEQ ID NO: 580474 - DNA, 497 bp, Homo sapiens
  misc_feature: HIJSMM301CM9TS.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccaatctgttcttctatcttccccg

SEQ ID NO: 580475 - DNA, 498 bp, Homo sapiens
  misc_feature: HIJSMM301AO14T.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactagtggctgcacca

SEQ ID NO: 580476 - DNA, 495 bp, Homo sapiens; identical to SEQ ID NO: 536359
  misc_feature: HIJSMM301BR7ZX.48.4.A04.1.454.light.4.raw

SEQ ID NO: 580477 - DNA, 504 bp, Homo sapiens
  misc_feature: HIJSMM301CP9ON.53.33.C11.1.454.light.4.raw
cgcgtatacacacgaccggtgctcgatttagagtgagctcgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctcg

SEQ ID NO: 580478 - DNA, 483 bp, Homo sapiens; identical to SEQ ID NO: 571177
  misc_feature: HIJSMM301AQN0V.17.26.C04.1.454.light.4.raw

SEQ ID NO: 580479 - DNA, 494 bp, Homo sapiens; identical to SEQ ID NO: 534994
  misc_feature: HIJSMM301BWU8B.27.78.H01.1.454.light.4.raw

SEQ ID NO: 580480 - DNA, 510 bp, Homo sapiens
  misc_feature: HIJSMM301CM9ZH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccagggaccgaaggtggaaagtacaaacgaacctagtggcgtgcaccactctgtcttctatcttccccg

SEQ ID NO: 580481 - DNA, 509 bp, Homo sapiens
  misc_feature: HIJSMM301CZB4A.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaagccggggatgaggccgactactactgtcagctgtgggacagtagtattcatcgagggggcagttcggcggagggaccaagctgaccgtcctgggtcagcccaaggctcgccccctcggtcacttcg

SEQ ID NO: 580482 - DNA, 514 bp, Homo sapiens; identical to SEQ ID NO: 538885
  misc_feature: HIJSMM301DT8DJ.14.19.B08.1.454.light.4.raw

SEQ ID NO: 580483 - DNA, 521 bp, Homo sapiens; identical to SEQ ID NO: 536990
  misc_feature: HIJSMM301DNX0H.27.23.C01.1.454.light.4.raw
  modified_base (517)..(517): a, c, t, g, unknown or other

SEQ ID NO: 580484 - DNA, 505 bp, Homo sapiens; identical to SEQ ID NO: 535503
  misc_feature: HIJSMM301CJ6FQ.8.28.C06.1.454.light.4.raw

SEQ ID NO: 580485 - DNA, 503 bp, Homo sapiens
  misc_feature: HIJSMM301BKYSN.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctggaccaaaattgagatcaaacgaactgtggctgcaccatctgtcttcatcttcccgcc

SEQ ID NO: 580486 - DNA, 485 bp, Homo sapiens
  misc_feature: HIJSMM301BOLQG.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagttccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgaa

SEQ ID NO: 580487 - DNA, 497 bp, Homo sapiens; identical to SEQ ID NO: 536376
  misc_feature: HIJSMM301A685Q.22.9.A09.1.454.light.4.raw

SEQ ID NO: 580488 - DNA, 486 bp, Homo sapiens
  misc_feature: HIJSMM301CH5RN.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgccctcggggatctccgagagattctctgcatcaacgtcaggaaacatagcctccctgaccattactggactccagcctgaggacgaggctgactattactgctcagcatgggacagcagcctcaatgttgggtgttcggcggagggaccaagctgaccgtcctaggtcacgg

SEQ ID NO: 580489 - DNA, 461 bp, Homo sapiens
  misc_feature: HIJSMM301EHNR7.52.2.A02.1.454.light.4.raw
  modified_base (305)..(305): a, c, t, g, unknown or other
cgcagtacgacacgaccggtgctcgatttagactcatctacaggggaggagtcagtcccaaccaggacacagcatggacatgagggtccctgctcagctcctgggctcctgctgctctggctctcaggtgccagatgtatcatccagatgacccagtctccatcctcctgtctgcatctataggagacagaatcaccatcacttgccgggcgagtcaggacattaacatgtatctgaattggtatcagcagaaaccagggaaagcccctaaactcctgatcctcgatgcatccaatttggaaacngggtccatcaaggttcagtggaagtggctctgggacagattttactttcaccatcgccagactgcagcctgaagatattgcaacatattactgtcaacagtatgataatcttcccgctcactttcggcggagggaccaaggtggagatcagacgaa

SEQ ID NO: 580490 - DNA, 503 bp, Homo sapiens; identical to SEQ ID NO: 535140
  misc_feature: HIJSMM301C1IBK.18.37.D04.1.454.light.4.raw

SEQ ID NO: 580491 - DNA, 488 bp, Homo sapiens; identical to SEQ ID NO: 535861
  misc_feature: HIJSMM301C6OU9.14.55.E11.1.454.light.4.raw

SEQ ID NO: 580492 - DNA, 502 bp, Homo sapiens
  misc_feature: HIJSMM301CNT8Y.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgcccctcggtc

SEQ ID NO: 580493 - DNA, 494 bp, Homo sapiens
  misc_feature: HIJSMM301C3FVS.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggagttcggccagggaccaaggtggacatacaaacgaactacgtaggctgcaccactctgtctt

SEQ ID NO: 580494 - DNA, 494 bp, Homo sapiens
  misc_feature: HIJSMM301BKV7M.4.27.C05.1.454.light.4.raw
agcactgtagcacgaccggtgctcgatttagacgcgatcgaagggtttggggctgggcctcaggaagcagcatcggaggtgcctcagccatgacatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtctgggtcagcccaaggctgccccctcggtcactc

SEQ ID NO: 580495 - DNA, 492 bp, Homo sapiens
  misc_feature: HIJSMM301BVCHR.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccaatcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcat

SEQ ID NO: 580496 - DNA, 472 bp, Homo sapiens
  misc_feature: HIJSMM301CS92T.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtcctaagtcagccc

SEQ ID NO: 580497 - DNA, 469 bp, Homo sapiens
  misc_feature: HIJSMM301B6FT1.18.9.A09.1.454.light.4.raw
tacgagtatgcacgaccggtgctcgatttagcgagacgcgcagggtcctgggcccagtctgtgctgacgcagccgccccagacactgagggcggctgcgtcagcacagactgggcccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 580498 - DNA, 491 bp, Homo sapiens; identical to SEQ ID NO: 544714
  misc_feature: HIJSMM301BPSDY.18.11.A11.1.454.light.4.raw

SEQ ID NO: 580499 - DNA, 505 bp, Homo sapiens
  misc_feature: HIJSMM301BD7BY.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtctaagtcagcccaaggctgccccctcggt

SEQ ID NO: 580500 - DNA, 465 bp, Homo sapiens
  misc_feature: HIJSMM301E17LJ.49.28.C06.1.454.light.4.raw
agtcgagagacacgaccggtgctcgatttagagctcacgtattgggtttggggagtcccaatcaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccgaaggtggagatcaagcgaa

SEQ ID NO: 580501 - DNA, 501 bp, Homo sapiens
  misc_feature: HIJSMM301ASRPK.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaagtcaaacgaactagtggctgcaccatctgtcttcta

SEQ ID NO: 580502 - DNA, 480 bp, Homo sapiens
  misc_feature: HIJSMM301AKXNJ.43.87.H10.1.454.light.4.raw
tgtgagtagtcacgaccggtgctcgatttagcagtactgcgttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttggtgttcggcggagggaccaagctgaccgtcctac

SEQ ID NO: 580503 - DNA, 354 bp, Homo sapiens; identical to SEQ ID NO: 535026
  misc_feature: HIJSMM301CW0C5.19.22.B11.1.454.light.4.raw

SEQ ID NO: 580504 - DNA, 491 bp, Homo sapiens
  misc_feature: HIJSMM301A95BM.51.71.G05.1.454.light.4.raw
cgatcgtatacacgaccggtgctcgatttagtgtcgtcgcaagagagaggggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgacaaggtcacgtcctgggtcagcccaaggccaacccactgtca

SEQ ID NO: 580505 - DNA, 517 bp, Homo sapiens; identical to SEQ ID NO: 541596
  misc_feature: HIJSMM301CNJ4E.19.80.H03.1.454.light.4.raw

SEQ ID NO: 580506 - DNA, 494 bp, Homo sapiens; identical to SEQ ID NO: 537418
  misc_feature: HIJSMM301D1Z5O.9.1.A01.1.454.light.4.raw

SEQ ID NO: 580507 - DNA, 490 bp, Homo sapiens; identical to SEQ ID NO: 535234
  misc_feature: HIJSMM301BQ1HT.17.21.B10.1.454.light.4.raw

SEQ ID NO: 580508 - DNA, 485 bp, Homo sapiens; identical to SEQ ID NO: 538956
  misc_feature: HIJSMM301DT2YV.40.69.G03.1.454.light.4.raw

SEQ ID NO: 580509 - DNA, 495 bp, Homo sapiens
  misc_feature: HIJSMM301D6ALJ.43.20.B09.1.454.light.4.raw
tgtgagtagtcacgaccggtgctcgatttagtgtagtgtgaagggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatacaaacgaactagtggctgcaccatctgtcttcatt

SEQ ID NO: 580510 - DNA, 483 bp, Homo sapiens
  misc_feature: HIJSMM301DDMR5.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtggggtcccatcaagattcagtggcggtggatctgggacagatttcactctcaccatcaacagtctgcagattgaggattatgcaacttattactgtcagcagagttccaggaccccgctcactttcggcgggggaccaaagtggacgtcaaacgaactgtggctgcaccat

SEQ ID NO: 580511 - DNA, 494 bp, Homo sapiens; identical to SEQ ID NO: 545671
  misc_feature: HIJSMM301BDN3R.9.1.A01.1.454.light.4.raw

SEQ ID NO: 580512 - DNA, 494 bp, Homo sapiens; identical to SEQ ID NO: 535184
  misc_feature: HIJSMM301AL539.16.71.G05.1.454.light.4.raw

SEQ ID NO: 580513 - DNA, 509 bp, Homo sapiens; identical to SEQ ID NO: 536047
  misc_feature: HIJSMM301AXSYY.17.33.C11.1.454.light.4.raw

SEQ ID NO: 580514 - DNA, 479 bp, Homo sapiens; identical to SEQ ID NO: 536050
  misc_feature: HIJSMM301B5WP2.5.73.G07.1.454.light.4.raw

SEQ ID NO: 580515 - DNA, 520 bp, Homo sapiens
  misc_feature: HIJSMM301DM41U.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagttctgcctacacggcctcctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcct

SEQ ID NO: 580516 - DNA, 486 bp, Homo sapiens; identical to SEQ ID NO: 537238
  misc_feature: HIJSMM301BNOYL.19.71.G05.1.454.light.4.raw

SEQ ID NO: 580517 - DNA, 491 bp, Homo sapiens
  misc_feature: HIJSMM301D2NM4.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcaggggatccctgagcgattctctggctccaattctgggaacacagccactctgaccaatcaccgggacccaggctgtagatgaggctgactattactgtcaggcgtgggacagcagcactgaggtgttcggcggagggaccaaagctgaccgtcctacgtcagcccaaggctgccccccg

SEQ ID NO: 580518 - DNA, 504 bp, Homo sapiens
  misc_feature: HIJSMM301A4TFV.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaagtaggatatcaaacgaactgtggctgcaccatctgtctt

SEQ ID NO: 580519 - DNA, 500 bp, Homo sapiens
  misc_feature: HIJSMM301E1IJP.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccgcctcctc

SEQ ID NO: 580520 - DNA, 516 bp, Homo sapiens
  misc_feature: HIJSMM301AGOQ9.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccacttcggtcggagggaccgaaactaagaggtacgaacgaaactacgtaggtcgtgtcaccactactcgtcttctact

SEQ ID NO: 580521 - DNA, 444 bp, Homo sapiens; identical to SEQ ID NO: 535027
  misc_feature: HIJSMM301D2P0K.8.73.G07.1.454.light.4.raw

SEQ ID NO: 580522 - DNA, 493 bp, Homo sapiens
  misc_feature: HIJSMM301BILLW.47.64.F09.1.454.light.4.raw
agctcacgtacacgaccggtgctcgatttagcgcgtatacaagggggagggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcaccatctgtcttcat

SEQ ID NO: 580523 - DNA, 493 bp, Homo sapiens; identical to SEQ ID NO: 535047
  misc_feature: HIJSMM301DZEIK.16.53.E09.1.454.light.4.raw

SEQ ID NO: 580524 - DNA, 497 bp, Homo sapiens
  misc_feature: HIJSMM301CF8XS.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtggtaccatggtcaccgtcctaggtcagcccaagaccaaccccactgt

SEQ ID NO: 580525 - DNA, 495 bp, Homo sapiens
  misc_feature: HIJSMM301EQ0P6.43.37.D04.1.454.light.4.raw
tgtgagtagtcacgaccggtgctcgatttagtagcatactgttgggtttggggcagcttcagctgtgggtagagaagacaggactcaggacaatctccagcatggccagcttccctctcctcctcaccctcctcactcactgtgcagggtcctgggcccagtctgtggtgactcagccaccctcagcgtctgggacccccggacagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggcggagggaccaaggtgaccgtcctaggtcacg

SEQ ID NO: 580526 - DNA, 518 bp, Homo sapiens
  misc_feature: HIJSMM301ED6R7.48.17.B06.1.454.light.4.raw
  modified_base (514)..(514): a, c, t, g, unknown or other
agtatacatacacgaccggtgctcgatttagtcgatagtgaaggggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcaccaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccnccct

SEQ ID NO: 580527 - DNA, 500 bp, Homo sapiens; identical to SEQ ID NO: 546350
  misc_feature: HIJSMM301CUQGZ.51.19.B08.1.454.light.4.raw

SEQ ID NO: 580528 - DNA, 489 bp, Homo sapiens; identical to SEQ ID NO: 535139
  misc_feature: HIJSMM301AQEQE.14.55.E11.1.454.light.4.raw

SEQ ID NO: 580529 - DNA, 486 bp, Homo sapiens; identical to SEQ ID NO: 535385
  misc_feature: HIJSMM301EUKT2.19.71.G05.1.454.light.4.raw

SEQ ID NO: 580530 - DNA, 489 bp, Homo sapiens
  misc_feature: HIJSMM301CE2LB.53.32.C10.1.454.light.4.raw
cgcgtatacacacgaccggtgctcgatttagtatagacatcaacacacaaaggggtgggcctcaggaagcagcatcggaggtgcctcagccatggcatggatccctctcttcctcggcgtccttgcttactgcacaggatcggtggcctcctatgagctgagtcagccaccctcagtgtccgtgtccccaggacagacagtccgcatcacctgctctggagataaattgggggataaatttgcttgctggtatcaacagaagacaggccagtcccctgtgttggtcatttatcaagatgacaagcggccctcagggatccctgagcggttctctggctccaactctgggaacacagccactctgaccatcagcgggacccaggctatggatgaggctgactattactgtcaggcgtgggacagcagcactatggtgttcggcggagggaccaagctgaccgtcctaggtcagcccaaggctgccccccg

SEQ ID NO: 580531 - DNA, 490 bp, Homo sapiens
  misc_feature: HIJSMM301B8AGI.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaagggtggagatgaaaagaactgtggctgcaccat

SEQ ID NO: 580532 - DNA, 486 bp, Homo sapiens
  misc_feature: HIJSMM301DXMVS.52.23.C01.1.454.light.4.raw
  modified_base (481)..(481): a, c, t, g, unknown or other
cgcagtacgacacgaccggtgctcgatttagtacacgtgattagggattgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaataatgaagatctccccctcactttcggcggagggaccaaaggtggagatcagacgaactgtggctgnaccat

SEQ ID NO: 580533 - DNA, 491 bp, Homo sapiens
  misc_feature: HIJSMM301AH143.52.53.E09.1.454.light.4.raw
cgcagtacgacacgaccggtgctcgatttagagagagtgtgttgggtttgggggagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcatttggggtgttcgggcggagggaccaagttgaccgtcctaggtcagcccaaggctgcccccc

SEQ ID NO: 580534 - DNA, 498 bp, Homo sapiens; identical to SEQ ID NO: 537020
  misc_feature: HIJSMM301AIJFW.26.26.C04.1.454.light.4.raw

SEQ ID NO: 580535 - DNA, 502 bp, Homo sapiens; identical to SEQ ID NO: 541971
  misc_feature: HIJSMM301BLXOS.4.39.D06.1.454.light.4.raw

SEQ ID NO: 580536 - DNA, 491 bp, Homo sapiens
  misc_feature: HIJSMM301CBGN4.48.57.F02.1.454.light.4.raw
agtatacatacacgaccggtgctcgatttagctcgatatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 580537 - DNA, 518 bp, Homo sapiens; identical to SEQ ID NO: 545878
  misc_feature: HIJSMM301CCYK9.41.25.C03.1.454.light.4.raw

SEQ ID NO: 580538 - DNA, 504 bp, Homo sapiens; identical to SEQ ID NO: 539083
  misc_feature: HIJSMM301A9OYO.8.19.B08.1.454.light.4.raw

SEQ ID NO: 580539 - DNA, 500 bp, Homo sapiens; identical to SEQ ID NO: 546613
  misc_feature: HIJSMM301BFFSR.11.21.B10.1.454.light.4.raw

SEQ ID NO: 580540 - DNA, 490 bp, Homo sapiens
  misc_feature: HIJSMM301DXKQ9.51.71.G05.1.454.light.4.raw
cgatcgtatacacgaccggtgctcgatttagtgtcgtcgcaagagagaggggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccc

SEQ ID NO: 580541 - DNA, 500 bp, Homo sapiens
  misc_feature: HIJSMM301ELBV0.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctctctgacaatctctgggctccaggctgacgacgaggctaattattactgctgctcatatgaaggttataacactatactattcggcggagggaccaagctgaccgtcctgcgtcagcccaaggctgccccctcggtcta

SEQ ID NO: 580542 - DNA, 496 bp, Homo sapiens; identical to SEQ ID NO: 535109
  misc_feature: HIJSMM301A7ECT.16.78.H01.1.454.light.4.raw

SEQ ID NO: 580543 - DNA, 507 bp, Homo sapiens
  misc_feature: HIJSMM301BCR1X.47.55.E11.1.454.light.4.raw
agctcacgtacacgaccggtgctcgatttagcactcgcacgttgggtttggggagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaacccactgtca

SEQ ID NO: 580544 - DNA, 479 bp, Homo sapiens; identical to SEQ ID NO: 542895
  misc_feature: HIJSMM301CFKSY.40.59.F04.1.454.light.4.raw

SEQ ID NO: 580545 - DNA, 479 bp, Homo sapiens
  misc_feature: HIJSMM301CDCXD.48.34.D01.1.454.light.4.raw
agtatacatacacgaccggtgctcgatttagatcgtctgtgttgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagacccg

SEQ ID NO: 580546 - DNA, 486 bp, Homo sapiens; identical to SEQ ID NO: 535043
  misc_feature: HIJSMM301BIS3Y.46.35.D02.1.454.light.4.raw

SEQ ID NO: 580547 - DNA, 487 bp, Homo sapiens
  misc_feature: HIJSMM301ALT2C.48.28.C06.1.454.light.4.raw
agtatacatacacgaccggtgctcgatttagagctcacgtattgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctgccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgtt

SEQ ID NO: 580548 - DNA, 493 bp, Homo sapiens; identical to SEQ ID NO: 535047
  misc_feature: HIJSMM301EIMA1.16.53.E09.1.454.light.4.raw

SEQ ID NO: 580549 - DNA, 487 bp, Homo sapiens; identical to SEQ ID NO: 536206
  misc_feature: HIJSMM301DHKNG.47.38.D05.1.454.light.4.raw

SEQ ID NO: 580550 - DNA, 493 bp, Homo sapiens; identical to SEQ ID NO: 543205
  misc_feature: HIJSMM301EVSFY.51.6.A06.1.454.light.4.raw

SEQ ID NO: 580551 - DNA, 477 bp, Homo sapiens
  misc_feature: HIJSMM301C6I0Y.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagctccctggtcatcgctgggctccaggctgacgatgaggctgattattattgccagtcctatgacaacaccctgcgtggttttgctgttcggcgcgggac

SEQ ID NO: 580552 - DNA, 504 bp, Homo sapiens
  misc_feature: HIJSMM301BDF3W.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgacccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 580553 - DNA, 505 bp, Homo sapiens; identical to SEQ ID NO: 563996
  misc_feature: HIJSMM301ASYF5.5.86.H09.1.454.light.4.raw

SEQ ID NO: 580554 - DNA, 506 bp, Homo sapiens
  misc_feature: HIJSMM301DWN2U.15.86.H09.1.454.light.4.raw
tctacgtagccacgaccggtgctcgatttagtgctatagacttggggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtcctaggtcagcccaaggctgccccctggtcactctgttcccaccctcctcg

SEQ ID NO: 580555 - DNA, 496 bp, Homo sapiens
  misc_feature: HIJSMM301C1K1C.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttccggccaacgggacacgactggagattaaacgaactgtggctgcaccatctgtctt

SEQ ID NO: 580556 - DNA, 513 bp, Homo sapiens; identical to SEQ ID NO: 535719
  misc_feature: HIJSMM301C6JSL.17.33.C11.1.454.light.4.raw

SEQ ID NO: 580557 - DNA, 447 bp, Homo sapiens; identical to SEQ ID NO: 535020
  misc_feature: HIJSMM301EA8WA.18.9.A09.1.454.light.4.raw

SEQ ID NO: 580558 - DNA, 484 bp, Homo sapiens
  misc_feature: HIJSMM301DMF3C.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccaggtagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 580559 - DNA, 485 bp, Homo sapiens
  misc_feature: HIJSMM301DJ0MZ.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccgtcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 580560 - DNA, 511 bp, Homo sapiens
  misc_feature: HIJSMM301EREDW.18.78.H01.1.454.light.4.raw
  modified_base (438)..(438): a, c, t, g, unknown or other
  modified_base (442)..(442): a, c, t, g, unknown or other
  modified_base (507)..(507): a, c, t, g, unknown or other
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaaactcatgatttatgatgtcagtaatcggccctcaggggtttctaatcgcttctctggctccaagtctggcaacacggcctccctgaccatctctgggctccaggctgaggacgaggctgattattactgcagctcatatacaaagcacncgancactcaatcttcgtacgacgtcggaacgaagtccacctcgtagcacgaccgacgacccaaccctntcta

SEQ ID NO: 580561 - DNA, 500 bp, Homo sapiens
  misc_feature: HIJSMM301EEJDU.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgggggcctccggggacatcgtgatgacccagtctccagactccctggctgtgtctctgggcgagagggccaccatcaactgcaagtccagccagagtatttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtaggaaatcaaacgaactgtggctgcacc

SEQ ID NO: 580562 - DNA, 486 bp, Homo sapiens; identical to SEQ ID NO: 535917
  misc_feature: HIJSMM301ERL60.3.10.A10.1.454.light.4.raw

SEQ ID NO: 580563 - DNA, 504 bp, Homo sapiens; identical to SEQ ID NO: 539083
  misc_feature: HIJSMM301D8JE6.8.19.B08.1.454.light.4.raw

SEQ ID NO: 580564 - DNA, 516 bp, Homo sapiens
  misc_feature: HIJSMM301AX6XE.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcccaaccccactgtcactctgttccccg

SEQ ID NO: 580565 - DNA, 505 bp, Homo sapiens; identical to SEQ ID NO: 536254
  misc_feature: HIJSMM301B4N2D.7.71.G05.1.454.light.4.raw

SEQ ID NO: 580566 - DNA, 479 bp, Homo sapiens
  misc_feature: HIJSMM301C638V.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcgacggagggaccaaggtgcagatcaaacgaactgtgg

SEQ ID NO: 580567 - DNA, 373 bp, Homo sapiens
  misc_feature: HIJSMM301B215Q.40.60.F05.1.454.light.4.raw
tctagcgactcacgaccggtgctcgatttagtacgtcatcagggaaagggccaccctctcctgcagggccagtcagagtgtaaccaacaactacttaatgtggtaccagcaaaaacctggccaggctcccaggctcctcatctatggtgcatccaacagggccagtggcatcccagacaggtttagaggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttcccgccatctgaagtcgctaga

SEQ ID NO: 580568 - DNA, 495 bp, Homo sapiens; identical to SEQ ID NO: 548066
  misc_feature: HIJSMM301C4ZJ5.3.31.C09.1.454.light.4.raw

SEQ ID NO: 580569 - DNA, 444 bp, Homo sapiens; identical to SEQ ID NO: 535192
  misc_feature: HIJSMM301C4MK0.5.9.A09.1.454.light.4.raw

SEQ ID NO: 580570 - DNA, 481 bp, Homo sapiens
  misc_feature: HIJSMM301BQX0I.52.35.D02.1.454.light.4.raw
cgcagtacgacacgaccggtgctcgatttagcacacgatagttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtgggtcccatcaaggttcagcggcagtggatctgggacagaattcactctcacaatcagcagcctgcagcctgaagattttgcaacttattactgtcaacaccttaatagttactccttcactttcggccctggaccaagtggacatcaaacgaactgtggctgcaccatctgt

SEQ ID NO: 580571 - DNA, 486 bp, Homo sapiens; identical to SEQ ID NO: 561882
  misc_feature: HIJSMM301CUNIW.19.71.G05.1.454.light.4.raw

SEQ ID NO: 580572 - DNA, 484 bp, Homo sapiens; identical to SEQ ID NO: 568207
  misc_feature: HIJSMM301A2EBA.43.4.A04.1.454.light.4.raw

SEQ ID NO: 580573 - DNA, 483 bp, Homo sapiens
  misc_feature: HIJSMM301AOTC2.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagacctttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttatactgtatgcaaggtatagagcttcctccgacgttcggccaagggaccaaggtggaactcaaacgaactgtgctgcaccatctgtcttcatcttcccgccatctgactagtctacg

SEQ ID NO: 580574 - DNA, 484 bp, Homo sapiens; identical to SEQ ID NO: 535240
  misc_feature: HIJSMM301DSV8B.47.60.F05.1.454.light.4.raw

SEQ ID NO: 580575 - DNA, 494 bp, Homo sapiens; identical to SEQ ID NO: 541035
  misc_feature: HIJSMM301AS7A2.26.12.B01.1.454.light.4.raw

SEQ ID NO: 580576 - DNA, 494 bp, Homo sapiens
  misc_feature: HIJSMM301DY7YT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggcctaggggaccaagctggagagtacaaacgaactgt

SEQ ID NO: 580577 - DNA, 494 bp, Homo sapiens
  misc_feature: HIJSMM301AUQQ0.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttttactgtcagcagtatagtaactggcctccgtacacttttggctaggggaccaagctagaaatcaaacgaactgtggctgcaccatctgtcttcta

SEQ ID NO: 580578 - DNA, 489 bp, Homo sapiens; identical to SEQ ID NO: 535139
  misc_feature: HIJSMM301ASG3L.14.55.E11.1.454.light.4.raw

SEQ ID NO: 580579 - DNA, 486 bp, Homo sapiens; identical to SEQ ID NO: 537428
  misc_feature: HIJSMM301DOW3R.47.62.F07.1.454.light.4.raw

SEQ ID NO: 580580 - DNA, 495 bp, Homo sapiens; identical to SEQ ID NO: 538651
  misc_feature: HIJSMM301BASI5.10.79.H02.1.454.light.4.raw

SEQ ID NO: 580581 - DNA, 501 bp, Homo sapiens
  misc_feature: HIJSMM301AVH27.48.26.C04.1.454.light.4.raw
agtatacatacacgaccggtgctcgatttagtctagcgactttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctc

SEQ ID NO: 580582 - DNA, 496 bp, Homo sapiens
  misc_feature: HIJSMM301DE4W6.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggttattactgcatgcaaggtctacaaaccccgatcaccttcggccgagggacacgcctggagattaaacgaactgtggctgcacc

SEQ ID NO: 580583 - DNA, 499 bp, Homo sapiens; identical to SEQ ID NO: 544831
  misc_feature: HIJSMM301CU1KK.41.53.E09.1.454.light.4.raw

SEQ ID NO: 580584 - DNA, 488 bp, Homo sapiens
  misc_feature: HIJSMM301AU0NN.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggcggagggaccaaggcggagatcagacgaactgtggctgcaccatctgtcttc

SEQ ID NO: 580585 - DNA, 488 bp, Homo sapiens; identical to SEQ ID NO: 579282
  misc_feature: HIJSMM301APH61.47.70.G04.1.454.light.4.raw

SEQ ID NO: 580586 - DNA, 486 bp, Homo sapiens
  misc_feature: HIJSMM301E1RF0.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaa

SEQ ID NO: 580587 - DNA, 484 bp, Homo sapiens
  misc_feature: HIJSMM301CK5CZ.15.1.A01.1.454.light.4.raw
  modified_base (467)..(467): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccnccctcctcgctacgtag

SEQ ID NO: 580588 - DNA, 487 bp, Homo sapiens; identical to SEQ ID NO: 564581
  misc_feature: HIJSMM301C3BIZ.47.62.F07.1.454.light.4.raw

SEQ ID NO: 580589 - DNA, 492 bp, Homo sapiens
  misc_feature: HIJSMM301ENVQR.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccgaaggtgaccgtcctaggtcagccc

SEQ ID NO: 580590 - DNA, 420 bp, Homo sapiens; identical to SEQ ID NO: 540533
  misc_feature: HIJSMM301C904A.9.34.D01.1.454.light.4.raw

SEQ ID NO: 580591 - DNA, 478 bp, Homo sapiens
  misc_feature: HIJSMM301A8WQ6.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgactgcctccactttgcacggtgggtcccaccaacgttcagcggcagtggatctgggacagaattcactctcaccatcagcagcctgcagcctgatgatgctgcaacttattactgtcaacaatataacagttattggacgtttcggccaagggaccaaggtggaaatcaaacgaactgtggctgcacca

SEQ ID NO: 580592 - DNA, 486 bp, Homo sapiens
  misc_feature: HIJSMM301CYD47.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatcttatgtcttcggatctgggaccagggtcaccgtcctaggtccagcccaaggccaaa

SEQ ID NO: 580593 - DNA, 501 bp, Homo sapiens
  misc_feature: HIJSMM301BPMFU.17.10.A10.1.454.light.4.raw
  modified_base (454)..(454): a, c, t, g, unknown or other
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaaccccccaatgttggattcaattatgtgtcctggtaccagcaactcccgggatcagcccccaaactcctcatatatgaagataataagcgaccctcaggggttcctgaccgattctctggctccaagtctggcacgtctgccaccctgggcatcaccgcgctccagactggggacgaggccgagtatttctgcgcaacatgggattccagcctgacttctggggtnttcggcagtgggaccaagctgaccgtcctaggtcagcccaaggctcg

SEQ ID NO: 580594 - DNA, 483 bp, Homo sapiens; identical to SEQ ID NO: 567047
  misc_feature: HIJSMM301CUZ79.47.60.F05.1.454.light.4.raw

SEQ ID NO: 580595 - DNA, 483 bp, Homo sapiens
  misc_feature: HIJSMM301C6XHS.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatagtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggacccaggctggagatcagacgaactgt

SEQ ID NO: 580596 - DNA, 487 bp, Homo sapiens; identical to SEQ ID NO: 536536
  misc_feature: HIJSMM301B6E5X.26.45.E01.1.454.light.4.raw

SEQ ID NO: 580597 - DNA, 460 bp, Homo sapiens; identical to SEQ ID NO: 537107
  misc_feature: HIJSMM301AO2IM.22.28.C06.1.454.light.4.raw

SEQ ID NO: 580598 - DNA, 447 bp, Homo sapiens; identical to SEQ ID NO: 535201
  misc_feature: HIJSMM301D7OR8.18.9.A09.1.454.light.4.raw

SEQ ID NO: 580599 - DNA, 503 bp, Homo sapiens; identical to SEQ ID NO: 570373
  misc_feature: HIJSMM301DDXMF.18.59.F04.1.454.light.4.raw

SEQ ID NO: 580600 - DNA, 515 bp, Homo sapiens
  misc_feature: HIJSMM301AQ0YW.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctgctccatccttggacaaggctgccctcaccatcgacgggggcccaggcagatgatgaatctaattatcactgtgcgttgtatagttgggttttggctatttcggttgttcggtcgggagggacccgaggtcgaccgtccgtacgtcagccc

SEQ ID NO: 580601 - DNA, 516 bp, Homo sapiens
  misc_feature: HIJSMM301CRUH7.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaagttttcggggttttcggcggagggaccaagctgaccgtcctaagtcagcccaaggctcgccccctcggtcactcttccg

SEQ ID NO: 580602 - DNA, 498 bp, Homo sapiens; identical to SEQ ID NO: 544540
  misc_feature: HIJSMM301AQUYJ.41.20.B09.1.454.light.4.raw

SEQ ID NO: 580603 - DNA, 486 bp, Homo sapiens; identical to SEQ ID NO: 535043
  misc_feature: HIJSMM301DU6Q3.46.35.D02.1.454.light.4.raw

SEQ ID NO: 580604 - DNA, 496 bp, Homo sapiens; identical to SEQ ID NO: 575048
  misc_feature: HIJSMM301EWGFL.26.72.G06.1.454.light.4.raw

SEQ ID NO: 580605 - DNA, 489 bp, Homo sapiens; identical to SEQ ID NO: 538498
  misc_feature: HIJSMM301BS8EE.19.71.G05.1.454.light.4.raw

SEQ ID NO: 580606 - DNA, 508 bp, Homo sapiens
  misc_feature: HIJSMM301EICX5.8.42.D09.1.454.light.4.raw
ctcgcgtgtccacgaccggtgctcgatttagacacatacgcaggggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttccccacct

SEQ ID NO: 580607 - DNA, 499 bp, Homo sapiens
  misc_feature: HIJSMM301DPNXZ.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccggggaccaagctggaaatcaagcgaactgtggctgcaccatctgtcttcattttccccg

SEQ ID NO: 580608 - DNA, 485 bp, Homo sapiens
  misc_feature: HIJSMM301BPCM4.3.64.F09.1.454.light.4.raw
agacgcactccacgaccggtgctcgatttagcgcgtatacaagggggagtcagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatt

SEQ ID NO: 580609 - DNA, 501 bp, Homo sapiens; identical to SEQ ID NO: 543209
  misc_feature: HIJSMM301DCXDU.52.55.E11.1.454.light.4.raw

SEQ ID NO: 580610 - DNA, 454 bp, Homo sapiens; identical to SEQ ID NO: 534964
  misc_feature: HIJSMM301DCQAT.19.86.H09.1.454.light.4.raw

SEQ ID NO: 580611 - DNA, 510 bp, Homo sapiens
  misc_feature: HIJSMM301D1I9G.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccgccct

SEQ ID NO: 580612 - DNA, 488 bp, Homo sapiens
  misc_feature: HIJSMM301DTJAE.52.25.C03.1.454.light.4.raw
cgcagtacgacacgaccggtgctcgatttagtagtgtagatttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactagtggctgcaccatctgt

SEQ ID NO: 580613 - DNA, 503 bp, Homo sapiens; identical to SEQ ID NO: 539976
  misc_feature: HIJSMM301DF9GJ.47.55.E11.1.454.light.4.raw

SEQ ID NO: 580614 - DNA, 473 bp, Homo sapiens
  misc_feature: HIJSMM301DVLSK.18.59.F04.1.454.light.4.raw
tacgagtatgcacgaccggtgctcgatttagtacacacacttagggattggggagagagacccctcccctgggatcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccaccctcctccatactcgta

SEQ ID NO: 580615 - DNA, 491 bp, Homo sapiens; identical to SEQ ID NO: 535294
  misc_feature: HIJSMM301A7BLN.16.68.G02.1.454.light.4.raw

SEQ ID NO: 580616 - DNA, 454 bp, Homo sapiens; identical to SEQ ID NO: 534964
  misc_feature: HIJSMM301AQQ55.19.86.H09.1.454.light.4.raw

SEQ ID NO: 580617 - DNA, 508 bp, Homo sapiens; identical to SEQ ID NO: 550253
  misc_feature: HIJSMM301DYM45.9.55.E11.1.454.light.4.raw

SEQ ID NO: 580618 - DNA, 483 bp, Homo sapiens
  misc_feature: HIJSMM301CCQ6C.4.41.D08.1.454.light.4.raw
agcactgtagcacgaccggtgctcgatttagtcacgcgagaaagggaaagggggagtcagacccagtcaggacacagcatggacatgagggtccccgctcagctcctggggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatcaaacgaactgtggctgcacat

SEQ ID NO: 580619 - DNA, 494 bp, Homo sapiens
  misc_feature: HIJSMM301A6TXQ.10.72.G06.1.454.light.4.raw
catagtagtgcacgaccggtgctcgatttagctacgactgcaagggaaaggggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 580620 - DNA, 383 bp, Homo sapiens; identical to SEQ ID NO: 447524
  misc_feature: HIJSMM301DN4PQ.41.26.C04.1.454.light.4.raw

SEQ ID NO: 580621 - DNA, 492 bp, Homo sapiens
  misc_feature: HIJSMM301APB9R.41.12.B01.1.454.light.4.raw
tctatactatcacgaccggtgctcgatttagtagtgtagattccgcgggcacgaccggtgctcgatttagtagcatactgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggt

SEQ ID NO: 580622 - DNA, 505 bp, Homo sapiens; identical to SEQ ID NO: 536117
  misc_feature: HIJSMM301AN3AU.8.71.G05.1.454.light.4.raw

SEQ ID NO: 580623 - DNA, 497 bp, Homo sapiens
  misc_feature: HIJSMM301BWETA.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggccgaacggaccgaaggtaggaagtacaaacgaactagtggctgcaccactctgtt

SEQ ID NO: 580624 - DNA, 518 bp, Homo sapiens; identical to SEQ ID NO: 570534
  misc_feature: HIJSMM301BANTN.22.30.C08.1.454.light.4.raw

SEQ ID NO: 580625 - DNA, 486 bp, Homo sapiens; identical to SEQ ID NO: 535917
  misc_feature: HIJSMM301CA722.3.10.A10.1.454.light.4.raw

SEQ ID NO: 580626 - DNA, 447 bp, Homo sapiens; identical to SEQ ID NO: 535020
  misc_feature: HIJSMM301DDVUK.18.9.A09.1.454.light.4.raw

SEQ ID NO: 580627 - DNA, 444 bp, Homo sapiens; identical to SEQ ID NO: 535594
  misc_feature: HIJSMM301A7VWH.9.9.A09.1.454.light.4.raw

SEQ ID NO: 580628 - DNA, 486 bp, Homo sapiens; identical to SEQ ID NO: 535290
  misc_feature: HIJSMM301CYZW2.3.12.B01.1.454.light.4.raw

SEQ ID NO: 580629 - DNA, 511 bp, Homo sapiens
  misc_feature: HIJSMM301AWH60.8.34.D01.1.454.light.4.raw
ctcgcgtgtccacgaccggtgctcgatttagatcgtctgtgttgggtttgggggaggaactgctcagttaggacccagagggaaccatagaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggccgtccggggccgacttcggcccgtcgggacaacggtggagtatcaaacgaactgtggctgcaccatctgtcttcta

SEQ ID NO: 580630 - DNA, 493 bp, Homo sapiens; identical to SEQ ID NO: 540179
  misc_feature: HIJSMM301ECG4E.27.78.H01.1.454.light.4.raw

SEQ ID NO: 580631 - DNA, 515 bp, Homo sapiens
  misc_feature: HIJSMM301EJV0E.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccgccctcct

SEQ ID NO: 580632 - DNA, 504 bp, Homo sapiens; identical to SEQ ID NO: 554247
  misc_feature: HIJSMM301A5OZS.19.78.H01.1.454.light.4.raw

SEQ ID NO: 580633 - DNA, 503 bp, Homo sapiens
  misc_feature: HIJSMM301DUQLT.21.38.D05.1.454.light.4.raw
tcgtcgctcgcacgaccggtgctcgatttagtatctgatagttgggtttgggggaagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatcttccccg

SEQ ID NO: 580634 - DNA, 490 bp, Homo sapiens; identical to SEQ ID NO: 550493
  misc_feature: HIJSMM301B8H88.10.59.F04.1.454.light.4.raw

SEQ ID NO: 580635 - DNA, 488 bp, Homo sapiens; identical to SEQ ID NO: 542699
  misc_feature: HIJSMM301CSVOV.12.51.E07.1.454.light.4.raw

SEQ ID NO: 580636 - DNA, 482 bp, Homo sapiens
  misc_feature: HIJSMM301BXF72.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagatttttactttcaccatcaccagcctgcagcctgaagatattgcaacatattactgtcaacagtatgataatctccctcccactttcggcggagggaccaaggtggagatcaaacgaactgtggctgcacc

SEQ ID NO: 580637 - DNA, 498 bp, Homo sapiens
  misc_feature: HIJSMM301AJO9C.10.65.F10.1.454.light.4.raw
catagtagtgcacgaccggtgctcgatttagctacgctctaaggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggaggaccgaaggtggagatcaaacgaactagtgctgcaccatctgtcttcatcttccccg

SEQ ID NO: 580638 - DNA, 492 bp, Homo sapiens; identical to SEQ ID NO: 536010
  misc_feature: HIJSMM301ECPMD.10.20.B09.1.454.light.4.raw

SEQ ID NO: 580639 - DNA, 488 bp, Homo sapiens; identical to SEQ ID NO: 542699
  misc_feature: HIJSMM301BEM1B.12.51.E07.1.454.light.4.raw

SEQ ID NO: 580640 - DNA, 497 bp, Homo sapiens
  misc_feature: HIJSMM301ALQ1U.49.9.A09.1.454.light.4.raw
agtcgagagacacgaccggtgctcgatttagcgagacgcgcagggcacgaccggtgctcgatttagatcgtctgtgttgggtttgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgttttcggtcggagggaccaggctgaccgtccg

SEQ ID NO: 580641 - DNA, 499 bp, Homo sapiens; identical to SEQ ID NO: 543588
  misc_feature: HIJSMM301AJEIJ.19.78.H01.1.454.light.4.raw

SEQ ID NO: 580642 - DNA, 520 bp, Homo sapiens; identical to SEQ ID NO: 535686
  misc_feature: HIJSMM301ADR0T.41.19.B08.1.454.light.4.raw

SEQ ID NO: 580643 - DNA, 515 bp, Homo sapiens
  misc_feature: HIJSMM301CAEKY.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccgaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgctagtttattactgtcaacatcgtacgagtggccgtccggggccacgttcggccctcggacgaacgtagagtatactaacaactacgtggtcgtcgtcgaccactactctcgttctact

SEQ ID NO: 580644 - DNA, 496 bp, Homo sapiens; identical to SEQ ID NO: 536802
  misc_feature: HIJSMM301D71T5.5.24.C02.1.454.light.4.raw

SEQ ID NO: 580645 - DNA, 475 bp, Homo sapiens
  misc_feature: HIJSMM301BZEHJ.5.12.B01.1.454.light.4.raw
atcagacacgcacgaccggtgctcgatttagtagtgtagattccgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattatttgcagttcatatggtagtatgaagactcttgtgattttcggcggagggaccaaggctgaccgt

SEQ ID NO: 580646 - DNA, 495 bp, Homo sapiens
  misc_feature: HIJSMM301AFX3K.41.67.G01.1.454.light.4.raw
tctatactatcacgaccggtgctcgatttagagtatacatattgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaa

SEQ ID NO: 580647 - DNA, 514 bp, Homo sapiens
  misc_feature: HIJSMM301AT6CY.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtcctaggtcagcccaaggctgccccctcggtcactctgttcccacctcctcgctacgtaga

SEQ ID NO: 580648 - DNA, 491 bp, Homo sapiens; identical to SEQ ID NO: 569401
  misc_feature: HIJSMM301AH30B.22.65.F10.1.454.light.4.raw

SEQ ID NO: 580649 - DNA, 489 bp, Homo sapiens
  misc_feature: HIJSMM301DMBUZ.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcgccaagggaccaaggtggaaatcaaacgaactgtggctgcaccatctgtcttcatcttccgcat

SEQ ID NO: 580650 - DNA, 479 bp, Homo sapiens; identical to SEQ ID NO: 535118
  misc_feature: HIJSMM301C7EW0.13.59.F04.1.454.light.4.raw

SEQ ID NO: 580651 - DNA, 486 bp, Homo sapiens; identical to SEQ ID NO: 542256
  misc_feature: HIJSMM301A19W3.8.12.B01.1.454.light.4.raw

SEQ ID NO: 580652 - DNA, 495 bp, Homo sapiens; identical to SEQ ID NO: 580525
  misc_feature: HIJSMM301D58JT.43.37.D04.1.454.light.4.raw

SEQ ID NO: 580653 - DNA, 503 bp, Homo sapiens
  misc_feature: HIJSMM301B5P82.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagataaacgaaactgtggctgcacactcttcg

SEQ ID NO: 580654 - DNA, 505 bp, Homo sapiens
  misc_feature: HIJSMM301BHDNN.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccccta

SEQ ID NO: 580655 - DNA, 466 bp, Homo sapiens; identical to SEQ ID NO: 536398
  misc_feature: HIJSMM301C4IKU.3.20.B09.1.454.light.4.raw

SEQ ID NO: 580656 - DNA, 494 bp, Homo sapiens; identical to SEQ ID NO: 534994
  misc_feature: HIJSMM301C975A.27.78.H01.1.454.light.4.raw

SEQ ID NO: 580657 - DNA, 493 bp, Homo sapiens
  misc_feature: HIJSMM301CYWMO.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttaagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 580658 - DNA, 513 bp, Homo sapiens
  misc_feature: HIJSMM301CM79S.19.67.G01.1.454.light.4.raw
tactctcgtgcacgaccggtgctcgatttagagtatacatattgggtttgggacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcaggcgggtctgggacagatttcactctcaccatcagcagcctgcaggctgaagatgtggctagtttattactgtcagcaattatttttcttactcctccggtggaccggttcggtaccaagggaccagggtggaaatcagacgaactgtgctgcaccatctgtctt

SEQ ID NO: 580659 - DNA, 493 bp, Homo sapiens; identical to SEQ ID NO: 536246
  misc_feature: HIJSMM301B5NRZ.49.66.F11.1.454.light.4.raw

SEQ ID NO: 580660 - DNA, 383 bp, Homo sapiens; identical to SEQ ID NO: 540698
  misc_feature: HIJSMM301D8M21.41.28.C06.1.454.light.4.raw

SEQ ID NO: 580661 - DNA, 497 bp, Homo sapiens
  misc_feature: HIJSMM301DGFW6.3.10.A10.1.454.light.4.raw
agacgcactccacgaccggtgctcgatttagcgtcgatctcgaggggggaactgctcagttaggacccagacggaaccatggaagccccagcgcagcttctcttcctcctgctactctggctcccagatgccactggagaaatagtgatggcgcagtctccagccaccctgtctgtgtctccaggggaaagagccaccctctcctgcagggccagtcagtctgtttataacaacttagcctggtaccaacagagacctggccaggctcccaggctcctcatgtttggtgcttccaccagggccactggtatcccagccaggttcagtggcagtgggtctgggacagagttcactctcaccatcagcagcctgcagtctgaagattttgctaatttatttctgtcagcagtacaataattggcctttgacgttcggccaagggaccaaggtggaaactaaacgaactgtggctgcaccatctgtcttcatcttccgcc

SEQ ID NO: 580662 - DNA, 454 bp, Homo sapiens; identical to SEQ ID NO: 534964
  misc_feature: HIJSMM301B6B1F.19.86.H09.1.454.light.4.raw

SEQ ID NO: 580663 - DNA, 510 bp, Homo sapiens
  misc_feature: HIJSMM301A63D2.53.62.F07.1.454.light.4.raw
cgcgtatacacacgaccggtgctcgatttagtagtcgcataaagggaaagggcacgaccggtgctcgatttagtagtcgcataaagggaaagggggtgggctcaggaggcagagctctgggaatctcgccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccaacagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaagctgaccgtccg

SEQ ID NO: 580664 - DNA, 503 bp, Homo sapiens
  misc_feature: HIJSMM301BIHAV.40.33.C11.1.454.light.4.raw
tctagcgactcacgaccggtgctcgattagagtgagctcgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgtttcggcggagggaccaagctgaccgtcctaggtcagccaaggctgccccctc

SEQ ID NO: 580665 - DNA, 482 bp, Homo sapiens; identical to SEQ ID NO: 548045
  misc_feature: HIJSMM301DEDWR.47.62.F07.1.454.light.4.raw

SEQ ID NO: 580666 - DNA, 507 bp, Homo sapiens; identical to SEQ ID NO: 536666
  misc_feature: HIJSMM301D1PFY.11.57.F02.1.454.light.4.raw

SEQ ID NO: 580667 - DNA, 481 bp, Homo sapiens; identical to SEQ ID NO: 535993
  misc_feature: HIJSMM301AP0M2.21.25.C03.1.454.light.4.raw

SEQ ID NO: 580668 - DNA, 521 bp, Homo sapiens; identical to SEQ ID NO: 539470
  misc_feature: HIJSMM301AH0HL.27.23.C01.1.454.light.4.raw

SEQ ID NO: 580669 - DNA, 444 bp, Homo sapiens; identical to SEQ ID NO: 538511
  misc_feature: HIJSMM301D1B2Y.5.9.A09.1.454.light.4.raw
  modified_base (426)..(426): a, c, t, g, unknown or other

SEQ ID NO: 580670 - DNA, 516 bp, Homo sapiens
  misc_feature: HIJSMM301BDEV6.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaacgccccaaaactcttaatttctggcgtcaatcagcgaccctcacatgtttccagtcgattctctgcatccaagtctggcaacacggcctttctgacaatctctcaactccaggctgaagacgaggcttatttattactgctcctcatacgcagggtggcactattttttcttggtttttggcgggtcgggacccagatgactgtcctcagtcgagcccaaggctcgccccctcggt

SEQ ID NO: 580671 - DNA, 487 bp, Homo sapiens
  misc_feature: HIJSMM301D4ZV4.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccgaagtggaagtcaagcgaactgtggctgcaccatctgt

SEQ ID NO: 580672 - DNA, 514 bp, Homo sapiens
  misc_feature: HIJSMM301CEMC2.40.12.B01.1.454.light.4.raw
  modified_base (497)..(497): a, c, t, g, unknown or other
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgcccccncggtcactctgttcccg

SEQ ID NO: 580673 - DNA, 515 bp, Homo sapiens
  misc_feature: HIJSMM301CL78V.8.43.D10.1.454.light.4.raw
ctcgcgtgtccacgaccggtgctcgatttagactagcagtaagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttgggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccaccctcctccgacacgcg

SEQ ID NO: 580674 - DNA, 507 bp, Homo sapiens; identical to SEQ ID NO: 563344
  misc_feature: HIJSMM301BTN0Y.3.79.H02.1.454.light.4.raw

SEQ ID NO: 580675 - DNA, 511 bp, Homo sapiens; identical to SEQ ID NO: 535945
  misc_feature: HIJSMM301A1DN4.43.23.C01.1.454.light.4.raw

SEQ ID NO: 580676 - DNA, 514 bp, Homo sapiens
  misc_feature: HIJSMM301CB7H5.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggtactgggaccaagagtcaccgtcccgtagtcgagcccaacggaccgaacccccacctacgtcta

SEQ ID NO: 580677 - DNA, 508 bp, Homo sapiens
  misc_feature: HIJSMM301CQ6HE.48.30.C08.1.454.light.4.raw
agtatacatacacgaccggtgctcgatttagtctgacgtcaaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtactttttaggtttacgtcggaccttcggccaagggacacgactggagattaaacgaactgtggctgcaccta

SEQ ID NO: 580678 - DNA, 495 bp, Homo sapiens
  misc_feature: HIJSMM301DR5O2.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtactacttttggccaggggacccaggtggagatcagacgaactgtggctgcaccatctgttctcatctcccg

SEQ ID NO: 580679 - DNA, 505 bp, Homo sapiens; identical to SEQ ID NO: 536254
  misc_feature: HIJSMM301BKLQA.7.71.G05.1.454.light.4.raw

SEQ ID NO: 580680 - DNA, 494 bp, Homo sapiens; identical to SEQ ID NO: 534992
  misc_feature: HIJSMM301C64ZY.9.1.A01.1.454.light.4.raw

SEQ ID NO: 580681 - DNA, 416 bp, Homo sapiens
  misc_feature: HIJSMM301A9OPG.18.78.H01.1.454.light.4.raw
tacgagtatgcacgaccggtgctcgatttagtgtgagtagtttgggtttgggggcgtttgtctgggtctcctggacagtcgatcaccatctcctgcactggaaccagcagtgacgttggtggttataactatgtctcctggtaccaacagcacccaggcaaagccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 580682 - DNA, 494 bp, Homo sapiens; identical to SEQ ID NO: 534994
  misc_feature: HIJSMM301CNHCD.27.78.H01.1.454.light.4.raw

SEQ ID NO: 580683 - DNA, 495 bp, Homo sapiens; identical to SEQ ID NO: 553683
  misc_feature: HIJSMM301EQO1J.48.1.A01.1.454.light.4.raw

SEQ ID NO: 580684 - DNA, 516 bp, Homo sapiens
  misc_feature: HIJSMM301DIENY.43.81.H04.1.454.light.4.raw
tgtgagtagtcacgaccggtgctcgatttagtagtgtagattcgcggggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggtttcaggctccctccttggggcaaagctgccctgacactgtcaggtgtgcaccctgaggacgaggctgagtattactgtctgctccactttcgtactgcctgggtcttcggcgggggactcagttgaccgtcctaggtcagccaaggctgccccctcggtcactctcgttcccaccctcctcactactca

SEQ ID NO: 580685 - DNA, 455 bp, Homo sapiens
  misc_feature: HIJSMM301AT5WQ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctcgccccctcggtcactctgttcccaccctcctccacgagagta

SEQ ID NO: 580686 - DNA, 503 bp, Homo sapiens; identical to SEQ ID NO: 559148
  misc_feature: HIJSMM301EX2AZ.7.31.C09.1.454.light.4.raw

SEQ ID NO: 580687 - DNA, 453 bp, Homo sapiens; identical to SEQ ID NO: 554307
  misc_feature: HIJSMM301DLUMP.19.86.H09.1.454.light.4.raw

SEQ ID NO: 580688 - DNA, 504 bp, Homo sapiens
  misc_feature: HIJSMM301BU7KV.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggcctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccactgtca

SEQ ID NO: 580689 - DNA, 498 bp, Homo sapiens
  misc_feature: HIJSMM301E06NX.40.81.H04.1.454.light.4.raw
tctagcgactcacgaccggtgctcgatttagtagtgtagattcgcgggcacgaccggtgctcgatttagtagtgtagattcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaacctctacaaactgtgtggacggtcggccaagggaccaa

SEQ ID NO: 580690 - DNA, 486 bp, Homo sapiens
  misc_feature: HIJSMM301C37N8.18.9.A09.1.454.light.4.raw
  modified_base (461)..(461): a, c, t, g, unknown or other
  modified_base (468)..(468): a, c, t, g, unknown or other
  modified_base (484)..(484): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcacttctgtttcccacctccctccctactactacgtacgtacagnggccggngcgagacggcgactanag

SEQ ID NO: 580691 - DNA, 516 bp, Homo sapiens
  misc_feature: HIJSMM301AIIYA.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacaatgaggctgagtatcactgtggagagagcccaacacaattgatggccaagacggttgggtgttcggcggagggaccaagctgaccgtcctaggtcagcccaaggctgccccctcggtccactctgttcccacccctcctccgctacgt

SEQ ID NO: 580692 - DNA, 508 bp, Homo sapiens
  misc_feature: HIJSMM301ESGPU.17.2.A02.1.454.light.4.raw
  modified_base (497)..(497): a, c, t, g, unknown or other
cgtagactagcacgaccggtgctcgatttagactcatctacaggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaacccactgtcactcngttcccgccct

SEQ ID NO: 580693 - DNA, 416 bp, Homo sapiens; identical to SEQ ID NO: 535308
  misc_feature: HIJSMM301AODDQ.16.46.E02.1.454.light.4.raw

SEQ ID NO: 580694 - DNA, 499 bp, Homo sapiens
  misc_feature: HIJSMM301DELXG.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtcactctgttccccaccctcctccacgagagta

SEQ ID NO: 580695 - DNA, 460 bp, Homo sapiens; identical to SEQ ID NO: 536053
  misc_feature: HIJSMM301C92ZZ.22.28.C06.1.454.light.4.raw

SEQ ID NO: 580696 - DNA, 447 bp, Homo sapiens; identical to SEQ ID NO: 535020
  misc_feature: HIJSMM301ETHCK.18.9.A09.1.454.light.4.raw

SEQ ID NO: 580697 - DNA, 499 bp, Homo sapiens
  misc_feature: HIJSMM301B03OC.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggctgccccctcggtcactctgtcccgtcccc

SEQ ID NO: 580698 - DNA, 486 bp, Homo sapiens
  misc_feature: HIJSMM301C4E84.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggcctaggggaccaaactggatatcagacgaactgtgg

SEQ ID NO: 580699 - DNA, 489 bp, Homo sapiens
  misc_feature: HIJSMM301E3SBM.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcacgtgcgtgggttttcggtcggagggaccgaagctgaccgtcctacggtcagaccccg

SEQ ID NO: 580700 - DNA, 484 bp, Homo sapiens
  misc_feature: HIJSMM301D35XA.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 580701 - DNA, 514 bp, Homo sapiens; identical to SEQ ID NO: 540552
  misc_feature: HIJSMM301CAR4A.16.66.F11.1.454.light.4.raw

SEQ ID NO: 580702 - DNA, 481 bp, Homo sapiens; identical to SEQ ID NO: 535993
  misc_feature: HIJSMM301D47EJ.21.25.C03.1.454.light.4.raw

SEQ ID NO: 580703 - DNA, 444 bp, Homo sapiens; identical to SEQ ID NO: 535192
  misc_feature: HIJSMM301C9YCS.5.9.A09.1.454.light.4.raw

SEQ ID NO: 580704 - DNA, 501 bp, Homo sapiens; identical to SEQ ID NO: 535873
  misc_feature: HIJSMM301DD7XZ.17.27.C05.1.454.light.4.raw

SEQ ID NO: 580705 - DNA, 464 bp, Homo sapiens; identical to SEQ ID NO: 536640
  misc_feature: HIJSMM301EYUYM.26.78.H01.1.454.light.4.raw

SEQ ID NO: 580706 - DNA, 497 bp, Homo sapiens; identical to SEQ ID NO: 534982
  misc_feature: HIJSMM301BY3X6.26.80.H03.1.454.light.4.raw

SEQ ID NO: 580707 - DNA, 486 bp, Homo sapiens; identical to SEQ ID NO: 535043
  misc_feature: HIJSMM301DZPXH.46.35.D02.1.454.light.4.raw

SEQ ID NO: 580708 - DNA, 489 bp, Homo sapiens; identical to SEQ ID NO: 558406
  misc_feature: HIJSMM301BY2NX.19.15.B04.1.454.light.4.raw

SEQ ID NO: 580709 - DNA, 503 bp, Homo sapiens
  misc_feature: HIJSMM301ESIK3.48.26.C04.1.454.light.4.raw
agtatacatacacgaccggtgctcgatttagtctagcgactttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 580710 - DNA, 505 bp, Homo sapiens; identical to SEQ ID NO: 567186
  misc_feature: HIJSMM301COPG0.9.71.G05.1.454.light.4.raw

SEQ ID NO: 580711 - DNA, 501 bp, Homo sapiens; identical to SEQ ID NO: 535746
  misc_feature: HIJSMM301CSD0Y.18.11.A11.1.454.light.4.raw

SEQ ID NO: 580712 - DNA, 503 bp, Homo sapiens
  misc_feature: HIJSMM301CHSMY.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatggggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggccaaccccactgtcactctgttcccgccctcctcta

SEQ ID NO: 580713 - DNA, 505 bp, Homo sapiens
  misc_feature: HIJSMM301ALE76.22.15.B04.1.454.light.4.raw
acatacgcgtcacgaccggtgctcgatttagacagtatatatccgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaggatgaggctgattattactgcagctcatatggaggcagcgacaatttgggtgttcgggcggagggaccaagctgaccgtcctaggtcagcccaaggctgccccctcggtcta

SEQ ID NO: 580714 - DNA, 493 bp, Homo sapiens
  misc_feature: HIJSMM301BI5EL.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatacaaacgaactgtggctgcaccatctgtcttcatcttcccgccat

SEQ ID NO: 580715 - DNA, 483 bp, Homo sapiens
  misc_feature: HIJSMM301AGYTH.12.8.A08.1.454.light.4.raw
atacgacgtacacgaccggtgctcgatttagcatactctacaggggctgggcctcagggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtc

SEQ ID NO: 580716 - DNA, 486 bp, Homo sapiens
  misc_feature: HIJSMM301CJOZK.49.28.C06.1.454.light.4.raw
agtcgagagacacgaccggtgctcgatttagagctcacgtattgggtttgggggctgtgggtccaggaggcagaactctgggtgtctcaccatggcctggatccctctacttctccccctcctcactctctgcacagactctgaggcctcctatgagctgacacagccaccctcggtgtctgtgtcctcaggacagacggccagtatcacctgctctggagatgcattgccaaagcaatatgcttactggtaccagcagaagccaggccaggcccctgtcttgatcatttataaagactttgagagggcctcagggacccctgagcgattctctggctccagctcagcgacaacagtcacgttgaccatcagtggagtccgggcagaggacgagggctgactattactgtcagtcatcagacagtagtggcacttctgtcgtattcggcggaggggaccaagctgaccgtcctaggtcagcccaac

SEQ ID NO: 580717 - DNA, 490 bp, Homo sapiens; identical to SEQ ID NO: 562259
  misc_feature: HIJSMM301BVWER.16.73.G07.1.454.light.4.raw

SEQ ID NO: 580718 - DNA, 499 bp, Homo sapiens
  misc_feature: HIJSMM301ESJ70.48.32.C10.1.454.light.4.raw
agtatacatacacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagccggaagattttgcaatttattactgtcaccagtatggtagctcacctctaactttcggcggagggaccaaggtggagatcaaacgaactagtggctgcaccatctgtctt

SEQ ID NO: 580719 - DNA, 487 bp, Homo sapiens; identical to SEQ ID NO: 536206
  misc_feature: HIJSMM301ANCKB.47.38.D05.1.454.light.4.raw

SEQ ID NO: 580720 - DNA, 502 bp, Homo sapiens
  misc_feature: HIJSMM301A0KN0.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctacaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctc

SEQ ID NO: 580721 - DNA, 518 bp, Homo sapiens
  misc_feature: HIJSMM301A29ND.43.59.F04.1.454.light.4.raw
tgtgagtagtcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 580722 - DNA, 515 bp, Homo sapiens
  misc_feature: HIJSMM301CL5RV.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccacctcctccg

SEQ ID NO: 580723 - DNA, 447 bp, Homo sapiens; identical to SEQ ID NO: 535201
  misc_feature: HIJSMM301BD6GG.18.9.A09.1.454.light.4.raw

SEQ ID NO: 580724 - DNA, 503 bp, Homo sapiens; identical to SEQ ID NO: 537518
  misc_feature: HIJSMM301CHIR5.8.19.B08.1.454.light.4.raw

SEQ ID NO: 580725 - DNA, 485 bp, Homo sapiens; identical to SEQ ID NO: 536630
  misc_feature: HIJSMM301AJ8S4.13.56.F01.1.454.light.4.raw

SEQ ID NO: 580726 - DNA, 478 bp, Homo sapiens; identical to SEQ ID NO: 543315
  misc_feature: HIJSMM301EKFKA.26.72.G06.1.454.light.4.raw

SEQ ID NO: 580727 - DNA, 474 bp, Homo sapiens; identical to SEQ ID NO: 537034
  misc_feature: HIJSMM301BUURF.5.15.B04.1.454.light.4.raw

SEQ ID NO: 580728 - DNA, 489 bp, Homo sapiens
  misc_feature: HIJSMM301D264Y.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactctccgaggctcactttcggcgagggaccaaggtggagatcaaacgaactgtgg

SEQ ID NO: 580729 - DNA, 496 bp, Homo sapiens; identical to SEQ ID NO: 552950
  misc_feature: HIJSMM301DJHRA.3.71.G05.1.454.light.4.raw

SEQ ID NO: 580730 - DNA, 464 bp, Homo sapiens; identical to SEQ ID NO: 537982
  misc_feature: HIJSMM301AP1JE.17.28.C06.1.454.light.4.raw

SEQ ID NO: 580731 - DNA, 503 bp, Homo sapiens
  misc_feature: HIJSMM301EC9P8.17.10.A10.1.454.light.4.raw
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaacccccccaatgttggattcaattatgtgtcctggtaccagcaactcccgggatcagcccccaaactcctcatatatgaagataataagcgaccctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaaggctgaccgtcctaggtcagcccaaggctcg

SEQ ID NO: 580732 - DNA, 404 bp, Homo sapiens; identical to SEQ ID NO: 535530
  misc_feature: HIJSMM301CD9NT.4.35.D02.1.454.light.4.raw

SEQ ID NO: 580733 - DNA, 375 bp, Homo sapiens; identical to SEQ ID NO: 537938
  misc_feature: HIJSMM301EPX74.9.11.A11.1.454.light.4.raw

SEQ ID NO: 580734 - DNA, 492 bp, Homo sapiens; identical to SEQ ID NO: 576050
  misc_feature: HIJSMM301EAQPO.27.78.H01.1.454.light.4.raw

SEQ ID NO: 580735 - DNA, 505 bp, Homo sapiens
  misc_feature: HIJSMM301CIFE4.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctgccccctcggtcactctcgtt

SEQ ID NO: 580736 - DNA, 497 bp, Homo sapiens; identical to SEQ ID NO: 535286
  misc_feature: HIJSMM301C1UWC.18.59.F04.1.454.light.4.raw

SEQ ID NO: 580737 - DNA, 494 bp, Homo sapiens; identical to SEQ ID NO: 534992
  misc_feature: HIJSMM301DA5TC.9.1.A01.1.454.light.4.raw

SEQ ID NO: 580738 - DNA, 505 bp, Homo sapiens
  misc_feature: HIJSMM301D5T0N.8.42.D09.1.454.light.4.raw
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcagggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 580739 - DNA, 520 bp, Homo sapiens; identical to SEQ ID NO: 537173
  misc_feature: HIJSMM301CYV6H.27.23.C01.1.454.light.4.raw

SEQ ID NO: 580740 - DNA, 454 bp, Homo sapiens
  misc_feature: HIJSMM301EOK8J.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctgcccctcggtcactctgttcccgccctcctccacgacgagta

SEQ ID NO: 580741 - DNA, 485 bp, Homo sapiens; identical to SEQ ID NO: 579022
  misc_feature: HIJSMM301A6DQN.7.75.G09.1.454.light.4.raw

SEQ ID NO: 580742 - DNA, 515 bp, Homo sapiens; identical to SEQ ID NO: 536247
  misc_feature: HIJSMM301COUB3.14.19.B08.1.454.light.4.raw

SEQ ID NO: 580743 - DNA, 503 bp, Homo sapiens; identical to SEQ ID NO: 543299
  misc_feature: HIJSMM301BKEND.48.36.D03.1.454.light.4.raw

SEQ ID NO: 580744 - DNA, 524 bp, Homo sapiens
  misc_feature: HIJSMM301ERX62.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcccctccgttggggcaaagctcgccctgacactgtctggtgtgcagcctgaggacgaggctgactattactcgcctactcttactttggtggtgctgtgctattcggcggagggaccaagctgaccgtcttaagtcacgcccaaggctcgccccctcggtcactctcgttccccaccctccttcc

SEQ ID NO: 580745 - DNA, 494 bp, Homo sapiens; identical to SEQ ID NO: 535629
  misc_feature: HIJSMM301DMJCH.4.27.C05.1.454.light.4.raw

SEQ ID NO: 580746 - DNA, 380 bp, Homo sapiens
  misc_feature: HIJSMM301A82WU.12.78.H01.1.454.light.4.raw
atacgacgtacacgaccggtgctcgatttagtgtgagtagtttgggtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggtgggaccaagctgaccgtcctaggtcagcccaaggctgccccctcggtcactctgttcccaccctcctctacgtcgtat

SEQ ID NO: 580747 - DNA, 472 bp, Homo sapiens; identical to SEQ ID NO: 536302
  misc_feature: HIJSMM301D0MCA.18.76.G10.1.454.light.4.raw

SEQ ID NO: 580748 - DNA, 441 bp, Homo sapiens; identical to SEQ ID NO: 534971
  misc_feature: HIJSMM301DSPL8.11.3.A03.1.454.light.4.raw

SEQ ID NO: 580749 - DNA, 494 bp, Homo sapiens; identical to SEQ ID NO: 535090
  misc_feature: HIJSMM301CJNVX.27.78.H01.1.454.light.4.raw
  modified_base (403)..(403): a, c, t, g, unknown or other

SEQ ID NO: 580750 - DNA, 496 bp, Homo sapiens
  misc_feature: HIJSMM301BEDA0.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctggtctccaggctgaggacgaggctgattattactgcagctcatatacaagcaccagcactctctatgtcttcggaactgggaccaaggtcaccgtctaggtcagcccaagg

SEQ ID NO: 580751 - DNA, 487 bp, Homo sapiens
  misc_feature: HIJSMM301ET3CP.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaaccagggaaagtccctgaggtcctcatctatggtgcatccagtttgccaagtggggtcccagcaaggttcagtgggcagtggatctgggacagatttcactctcaccatcagcagtctacaacctgaagattttgcaacttactactgtcaacagagtttcagtacccctctgacgttcggccaagggaccaaggtggaaataaaacgaactagtggctgca

SEQ ID NO: 580752 - DNA, 495 bp, Homo sapiens; identical to SEQ ID NO: 535821
  misc_feature: HIJSMM301BOORF.3.31.C09.1.454.light.4.raw

SEQ ID NO: 580753 - DNA, 493 bp, Homo sapiens; identical to SEQ ID NO: 540127
  misc_feature: HIJSMM301AW0N0.10.17.B06.1.454.light.4.raw

SEQ ID NO: 580754 - DNA, 530 bp, Homo sapiens
  misc_feature: HIJSMM301D7BQJ.52.72.G06.1.454.light.4.raw
cgcagtacgacacgaccggtgctcgatttagctacgactgcaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccggaaatgacattggtggttataattatgtctcctggtaccaacaccacccaggcaaagcccccaaactcatgatttatggtgtcggtgaccggccctcaggggtttcgaatcgcttctctggctccaagtccggcaacacggcctccctgaccatctctggcctccaggccgaggacgaggctgattattactgcgcctcatatacaaacaacaacaattgggtgttcggcggagggaccaagctgaccgtcctaggtcagcccaaggctgccccctcggtcactctgttcccgccctcctctatacg

SEQ ID NO: 580755 - DNA, 513 bp, Homo sapiens; identical to SEQ ID NO: 565259
  misc_feature: HIJSMM301C82RE.17.33.C11.1.454.light.4.raw

SEQ ID NO: 580756 - DNA, 486 bp, Homo sapiens
  misc_feature: HIJSMM301AEVD4.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccgaaagtggatatcaaacgaactgtggctgcaccatctgtt

SEQ ID NO: 580757 - DNA, 490 bp, Homo sapiens
  misc_feature: HIJSMM301DCO2X.4.40.D07.1.454.light.4.raw
agcactgtagcacgaccggtgctcgatttagtgatagagcgtaacaacagagggggagctgctcagttaggacccagaggcaaccatggaaaccccagcgcagcttctcttcctcctgctactctggctcccagataccacaggagaagttgtgttgacgcagtctccaggcaccctgtctttgtctccaggggagagggccaccctctcctgcaggaccagtcagagtgataccaacaactttttagcctggtaccaacagaaagctggccaggctcccaggctcctcatctatggtgcatccatcagggccactggcatcccagacaggttcagtggcagtgggtctgggacagacttcactctcatcatcaacagactggagcctgaggattctgcagtgtattactgtcaccagtatggtggggcgcgcggttttcggcgggggaccgaaggtggacatcaaacgaactgtggctgcaccatctgt

SEQ ID NO: 580758 - DNA, 491 bp, Homo sapiens
  misc_feature: HIJSMM301BAG16.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcgagggaccaaggtggagaatcaaacgaactgtggctgcaccatctgtcttcatcttcccgcca

SEQ ID NO: 580759 - DNA, 496 bp, Homo sapiens; identical to SEQ ID NO: 535109
  misc_feature: HIJSMM301DEOW9.16.78.H01.1.454.light.4.raw

SEQ ID NO: 580760 - DNA, 444 bp, Homo sapiens; identical to SEQ ID NO: 535594
  misc_feature: HIJSMM301DXXF0.9.9.A09.1.454.light.4.raw

SEQ ID NO: 580761 - DNA, 506 bp, Homo sapiens
  misc_feature: HIJSMM301C1OVX.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgttctggagatgcattgccaaaaaaattgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataatttctgggtgttcggcggagggaccaaactgaccgtcctaggtcagcccaaggctgccccctcggtcactctgttcccta

SEQ ID NO: 580762 - DNA, 496 bp, Homo sapiens
  misc_feature: HIJSMM301A56EM.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatatatattcctcctcagacgttcggccaagggaccaaggtggaaatcaaacgaactgtggctgcacca

SEQ ID NO: 580763 - DNA, 515 bp, Homo sapiens
  misc_feature: HIJSMM301ANGK1.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagccaaggctgccccctcggtcact

SEQ ID NO: 580764 - DNA, 479 bp, Homo sapiens; identical to SEQ ID NO: 535188
  misc_feature: HIJSMM301B8NL5.10.74.G08.1.454.light.4.raw

SEQ ID NO: 580765 - DNA, 506 bp, Homo sapiens; identical to SEQ ID NO: 573948
  misc_feature: HIJSMM301BAICY.15.86.H09.1.454.light.4.raw

SEQ ID NO: 580766 - DNA, 491 bp, Homo sapiens; identical to SEQ ID NO: 535194
  misc_feature: HIJSMM301C4ZQ2.26.78.H01.1.454.light.4.raw

SEQ ID NO: 580767 - DNA, 490 bp, Homo sapiens; identical to SEQ ID NO: 538714
  misc_feature: HIJSMM301D3P5H.11.12.B01.1.454.light.4.raw

SEQ ID NO: 580768 - DNA, 447 bp, Homo sapiens; identical to SEQ ID NO: 535201
  misc_feature: HIJSMM301BMFAD.18.9.A09.1.454.light.4.raw

SEQ ID NO: 580769 - DNA, 499 bp, Homo sapiens
  misc_feature: HIJSMM301CSRCM.10.28.C06.1.454.light.4.raw
catagtagtgcacgaccggtgctcgatttagagctcacgtattgggtttgggggctttgcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcgggggaccgacactgaccgtcctaggtcagcccaaggctgcccctcggtcactctgttcccaccctcctccactactatg

SEQ ID NO: 580770 - DNA, 498 bp, Homo sapiens; identical to SEQ ID NO: 548622
  misc_feature: HIJSMM301C5AXB.11.59.F04.1.454.light.4.raw

SEQ ID NO: 580771 - DNA, 444 bp, Homo sapiens; identical to SEQ ID NO: 535192
  misc_feature: HIJSMM301BSBX5.5.9.A09.1.454.light.4.raw

SEQ ID NO: 580772 - DNA, 504 bp, Homo sapiens; identical to SEQ ID NO: 539083
  misc_feature: HIJSMM301DCD3R.8.19.B08.1.454.light.4.raw

SEQ ID NO: 580773 - DNA, 507 bp, Homo sapiens; identical to SEQ ID NO: 568626
  misc_feature: HIJSMM301BOGI2.19.78.H01.1.454.light.4.raw

SEQ ID NO: 580774 - DNA, 508 bp, Homo sapiens
  misc_feature: HIJSMM301BQN0F.5.86.H09.1.454.light.4.raw
atcagacacgcacgaccggtgctcgatttagtgctatagacttggggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggcgtccagactgaggatgaggctgactattactgcagctcatttgcaggcagccgtatactcttcggcggagggaccaagctgaccgtcctaggtcagcccaaggctcgccccctcggtccta

SEQ ID NO: 580775 - DNA, 521 bp, Homo sapiens
  misc_feature: HIJSMM301D2YGY.27.23.C01.1.454.light.4.raw
  modified_base (500)..(500): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccncggtcactctgttcccgccct

SEQ ID NO: 580776 - DNA, 499 bp, Homo sapiens
  misc_feature: HIJSMM301BE01P.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctctaccatccgcagcctagagcctgaagattttgcagtttattactgtcaacagcgtagcagcaggcctcggcgacgtcgcaggacagtggagtcaagcgaactgtggctgcaccatctgtcttcatcttcccgcc

SEQ ID NO: 580777 - DNA, 485 bp, Homo sapiens; identical to SEQ ID NO: 535501
  misc_feature: HIJSMM301DHRGH.3.10.A10.1.454.light.4.raw

SEQ ID NO: 580778 - DNA, 487 bp, Homo sapiens; identical to SEQ ID NO: 536536
  misc_feature: HIJSMM301BP5A4.26.45.E01.1.454.light.4.raw

SEQ ID NO: 580779 - DNA, 503 bp, Homo sapiens
  misc_feature: HIJSMM301CPYCC.48.35.D02.1.454.light.4.raw
agtatacatacacgaccggtgctcgatttagcacacgatagttgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 580780 - DNA, 489 bp, Homo sapiens
  misc_feature: HIJSMM301AKDMA.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggtcccgacggaccgaaacgtaggagtatacaaacgaaactacgtggcgtgcaccactactgtcttctatcttcccgtcccact

SEQ ID NO: 580781 - DNA, 502 bp, Homo sapiens
  misc_feature: HIJSMM301CO84K.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtccaccgtcctaggtcagcccaaggcccaacccc

SEQ ID NO: 580782 - DNA, 506 bp, Homo sapiens
  misc_feature: HIJSMM301C0Z2X.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctcgggacaccagcctcgctgcttggcttttcggcggagggaccaagctgaccgtcctgggtcagcccaaggctcgccccctcggtcta

SEQ ID NO: 580783 - DNA, 499 bp, Homo sapiens; identical to SEQ ID NO: 536578
  misc_feature: HIJSMM301CYE6I.22.27.C05.1.454.light.4.raw

SEQ ID NO: 580784 - DNA, 455 bp, Homo sapiens
  misc_feature: HIJSMM301D6N93.18.78.H01.1.454.light.4.raw
tacgagtatgcacgaccggtgctcgatttagtgtgagtagtttgggtttggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagccaaccccactgtcactctgttcccgccctcctccatactcgta

SEQ ID NO: 580785 - DNA, 500 bp, Homo sapiens; identical to SEQ ID NO: 540219
  misc_feature: HIJSMM301B92AU.43.34.D01.1.454.light.4.raw

SEQ ID NO: 580786 - DNA, 449 bp, Homo sapiens
  misc_feature: HIJSMM301DZNL7.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtaacctatgacatgaggctgagtggttcgtatgtcttcggatctgggaccaaggtcaccgtcctaagtcagcccaaggccaacccctctgtcactctgttcccgccctcctccatactcgta

SEQ ID NO: 580787 - DNA, 495 bp, Homo sapiens
  misc_feature: HIJSMM301BXORR.8.81.H04.1.454.light.4.raw
ctcgcgtgtccacgaccggtgctcgatttagtagtgtagattcgcggggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggtacacttttggccgggggaccaagctggagatcaaacgaactgtggctgcaccatctgtcttcta

SEQ ID NO: 580788 - DNA, 508 bp, Homo sapiens; identical to SEQ ID NO: 555366
  misc_feature: HIJSMM301BLHR6.47.85.H08.1.454.light.4.raw

SEQ ID NO: 580789 - DNA, 505 bp, Homo sapiens; identical to SEQ ID NO: 538422
  misc_feature: HIJSMM301DOBHD.19.78.H01.1.454.light.4.raw

SEQ ID NO: 580790 - DNA, 496 bp, Homo sapiens
  misc_feature: HIJSMM301E1X21.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttactcaagtgatcaccttcggccaagggacacgactggagattaaaacgaactgtggctgcacccaatctgtctt

SEQ ID NO: 580791 - DNA, 523 bp, Homo sapiens
  misc_feature: HIJSMM301BKVB8.48.28.C06.1.454.light.4.raw
agtatacatacacgaccggtgctcgatttagagctcacgtattgggtttggggggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccgccctcctcta

SEQ ID NO: 580792 - DNA, 520 bp, Homo sapiens; identical to SEQ ID NO: 537173
  misc_feature: HIJSMM301E1A4P.27.23.C01.1.454.light.4.raw

SEQ ID NO: 580793 - DNA, 441 bp, Homo sapiens; identical to SEQ ID NO: 550529
  misc_feature: HIJSMM301BI6GS.41.9.A09.1.454.light.4.raw

SEQ ID NO: 580794 - DNA, 502 bp, Homo sapiens; identical to SEQ ID NO: 537363
  misc_feature: HIJSMM301A1PS5.18.23.C01.1.454.light.4.raw

SEQ ID NO: 580795 - DNA, 490 bp, Homo sapiens
  misc_feature: HIJSMM301EIA9A.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggttcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 580796 - DNA, 472 bp, Homo sapiens; identical to SEQ ID NO: 536302
  misc_feature: HIJSMM301CN8AQ.18.76.G10.1.454.light.4.raw

SEQ ID NO: 580797 - DNA, 441 bp, Homo sapiens; identical to SEQ ID NO: 534971
  misc_feature: HIJSMM301DJ0KK.11.3.A03.1.454.light.4.raw

SEQ ID NO: 580798 - DNA, 491 bp, Homo sapiens
  misc_feature: HIJSMM301B5NXN.48.51.E07.1.454.light.4.raw
agtatacatacacgaccggtgctcgatttagcatactctacaacacacaaagggggaagacaatgggtttgatttagattacatgggtgacttttctgttttatttccaatctcagataccaccggagaaattgtgttgacgcagtctttaggcaccctgtctttgtctccagggaaaagagccaccctctcctgcagggccagtcagactgttagcagcagctactgagcctggtaccagctgaaacctggccaggctcccctgctcctcatctatggtgcatccagcagggccactggcatcccagacaggttcagtggcagtgggtctgggacagacttcactctcaccatcttcagactggagcctgaagattttgcagtgtattactgtcagcagtatggtaactcaacggaggacttttggccaggggaccaagctggagatcaaacgaactgtggctgcaccatctgtcttcatcttcccgcat

SEQ ID NO: 580799 - DNA, 514 bp, Homo sapiens; identical to SEQ ID NO: 541418
  misc_feature: HIJSMM301DUMMZ.17.33.C11.1.454.light.4.raw

SEQ ID NO: 580800 - DNA, 499 bp, Homo sapiens; identical to SEQ ID NO: 541382
  misc_feature: HIJSMM301BNCAI.11.21.B10.1.454.light.4.raw

SEQ ID NO: 580801 - DNA, 479 bp, Homo sapiens; identical to SEQ ID NO: 538892
  misc_feature: HIJSMM301D0ZQE.22.59.F04.1.454.light.4.raw

SEQ ID NO: 580802 - DNA, 503 bp, Homo sapiens
  misc_feature: HIJSMM301BABKG.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctcgcccctcggtcactctgtt

SEQ ID NO: 580803 - DNA, 488 bp, Homo sapiens; identical to SEQ ID NO: 535081
  misc_feature: HIJSMM301ESPLO.26.23.C01.1.454.light.4.raw

SEQ ID NO: 580804 - DNA, 504 bp, Homo sapiens
  misc_feature: HIJSMM301APSAF.41.21.B10.1.454.light.4.raw
tctatactatcacgaccggtgctcgatttagtgtcgtcgcaagagagggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttattcaggggcattcggccaagggaccaaggtggaaattaaacgaactgtggctgcaccatctgtcttcatcttcccgccta

SEQ ID NO: 580805 - DNA, 498 bp, Homo sapiens
  misc_feature: HIJSMM301DPUD4.51.22.B11.1.454.light.4.raw
cgatcgtatacacgaccggtgctcgatttagacgacagctcagggggcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcgggggaccaaacgtgaccgtcctaggtcagcccaaggctgcccctcggt

SEQ ID NO: 580806 - DNA, 504 bp, Homo sapiens
  misc_feature: HIJSMM301AI56Z.41.37.D04.1.454.light.4.raw
tctatactatcacgaccggtgctcgatttagtagcatactgttgggtttggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgcccccc

SEQ ID NO: 580807 - DNA, 500 bp, Homo sapiens; identical to SEQ ID NO: 579869
  misc_feature: HIJSMM301EKRC5.21.81.H04.1.454.light.4.raw

SEQ ID NO: 580808 - DNA, 472 bp, Homo sapiens
  misc_feature: HIJSMM301C5P0O.5.34.D01.1.454.light.4.raw
atcagacacgcacgaccggtgctcgatttagatcgtctgtgttgggtttggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtccatcaaggttcagcggcagtggatctgggacagatttcactctcaccatcagcagcctgcagcctgaagattttgcaacttactattgtcaacaggctaacagtttccctccgaccttcggccaagggacacgactcggagattaaacgaa

SEQ ID NO: 580809 - DNA, 526 bp, Homo sapiens
  misc_feature: HIJSMM301A2U82.27.23.C01.1.454.light.4.raw
agcgtcgtctcacgaccggtgctcgatttagtacacgtgattagggattggggggggtcccaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggcctgccccctcggtcactctgttcccgccctccct

SEQ ID NO: 580810 - DNA, 492 bp, Homo sapiens
  misc_feature: HIJSMM301AYTHW.40.53.E09.1.454.light.4.raw
tctagcgactcacgaccggtgctcgatttagagagagtgtgttgggtttggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtgttcggcggggggaccgaagctgaccgtcctaacgt

SEQ ID NO: 580811 - DNA, 504 bp, Homo sapiens
  misc_feature: HIJSMM301CA6JN.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggaccaaagtggaaatcaaacgaactgtggctgcaccatctgtctcatcttcccgc

SEQ ID NO: 580812 - DNA, 505 bp, Homo sapiens
  misc_feature: HIJSMM301COOUW.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaaggctgaccgtcctgggtcagcccaaggctgccccctcggtcta

SEQ ID NO: 580813 - DNA, 488 bp, Homo sapiens; identical to SEQ ID NO: 559983
  misc_feature: HIJSMM301EEXE4.17.34.D01.1.454.light.4.raw

SEQ ID NO: 580814 - DNA, 513 bp, Homo sapiens; identical to SEQ ID NO: 565714
  misc_feature: HIJSMM301CZV7U.8.23.C01.1.454.light.4.raw

SEQ ID NO: 580815 - DNA, 500 bp, Homo sapiens; identical to SEQ ID NO: 560850
  misc_feature: HIJSMM301CUUA1.15.1.A01.1.454.light.4.raw

SEQ ID NO: 580816 - DNA, 507 bp, Homo sapiens
  misc_feature: HIJSMM301AY4Q1.48.35.D02.1.454.light.4.raw
agtatacatacacgaccggtgctcgatttagcacacgatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 580817 - DNA, 471 bp, Homo sapiens
  misc_feature: HIJSMM301D8J4B.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcacttcgcctggactgaatgcatatgaagagaactgtggctgca

SEQ ID NO: 580818 - DNA, 494 bp, Homo sapiens
  misc_feature: HIJSMM301AMRAA.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgacttattactgtgcatcgacgggacgcaacatgggatgacatctgagcggtggtgtcgcggaggaccaactgacgtcctaggtcagcc

SEQ ID NO: 580819 - DNA, 508 bp, Homo sapiens
  misc_feature: HIJSMM301AD3KN.48.48.E04.1.454.light.4.raw
agtatacatacacgaccggtgctcgatttagagagcgtcacagagagaaggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggttttctggctccatcgttgggggcaaagccgccctcaccatcacgggggcccaggcagaggatgaggcgaattattattgtatgctccacaggggcagggggcacctgggagttcggcggcgggaccaagctgaccgtcctaggtcagcccaaggctgccccctggtca

SEQ ID NO: 580820 - DNA, 444 bp, Homo sapiens; identical to SEQ ID NO: 534993
  misc_feature: HIJSMM301EJ91N.5.9.A09.1.454.light.4.raw

SEQ ID NO: 580821 - DNA, 446 bp, Homo sapiens
  misc_feature: HIJSMM301C28LG.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccatggtcaccgtcctaagtcagcccaaggccaacccctctgtcactctgttcccgcctcctccatactcgta

SEQ ID NO: 580822 - DNA, 514 bp, Homo sapiens
  misc_feature: HIJSMM301CAZIP.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgacggaccgaacggtaggaagtacaagacgaactagtggcgtcggcaccactctgtcttctactcttcccgt

SEQ ID NO: 580823 - DNA, 496 bp, Homo sapiens
  misc_feature: HIJSMM301C6H7C.53.10.A10.1.454.light.4.raw
cgcgtatacacacgaccggtgctcgatttagcgtcgatctcaggggctgggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatggacagcgaaattgcggtgttcggcgggggaccaaactgaccgtcctaggtcagcccaaggctgccccctcggtcactctgttccccg

SEQ ID NO: 580824 - DNA, 486 bp, Homo sapiens; identical to SEQ ID NO: 553923
  misc_feature: HIJSMM301DMDF2.49.81.H04.1.454.light.4.raw

SEQ ID NO: 580825 - DNA, 481 bp, Homo sapiens; identical to SEQ ID NO: 545581
  misc_feature: HIJSMM301C2159.48.19.B08.1.454.light.4.raw

SEQ ID NO: 580826 - DNA, 501 bp, Homo sapiens; identical to SEQ ID NO: 573085
  misc_feature: HIJSMM301DQ6KW.48.78.H01.1.454.light.4.raw

SEQ ID NO: 580827 - DNA, 490 bp, Homo sapiens
  misc_feature: HIJSMM301D1P42.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcaactggcctctcaccttcggcggagggccaaggtggagatcaaacgaactgtggctgcaccatctgtt

SEQ ID NO: 580828 - DNA, 504 bp, Homo sapiens; identical to SEQ ID NO: 542411
  misc_feature: HIJSMM301DLD7A.9.53.E09.1.454.light.4.raw

SEQ ID NO: 580829 - DNA, 489 bp, Homo sapiens; identical to SEQ ID NO: 535139
  misc_feature: HIJSMM301ALZFZ.14.55.E11.1.454.light.4.raw

SEQ ID NO: 580830 - DNA, 503 bp, Homo sapiens; identical to SEQ ID NO: 535044
  misc_feature: HIJSMM301BNP78.19.78.H01.1.454.light.4.raw

SEQ ID NO: 580831 - DNA, 509 bp, Homo sapiens; identical to SEQ ID NO: 553073
  misc_feature: HIJSMM301BG68L.16.1.A01.1.454.light.4.raw

SEQ ID NO: 580832 - DNA, 494 bp, Homo sapiens; identical to SEQ ID NO: 534992
  misc_feature: HIJSMM301BQT0C.9.1.A01.1.454.light.4.raw

SEQ ID NO: 580833 - DNA, 508 bp, Homo sapiens; identical to SEQ ID NO: 561027
  misc_feature: HIJSMM301BDTR7.47.85.H08.1.454.light.4.raw

SEQ ID NO: 580834 - DNA, 472 bp, Homo sapiens; identical to SEQ ID NO: 539757
  misc_feature: HIJSMM301C0KDU.7.81.H04.1.454.light.4.raw

SEQ ID NO: 580835 - DNA, 477 bp, Homo sapiens
  misc_feature: HIJSMM301BZW41.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcacatctgtctt

SEQ ID NO: 580836 - DNA, 507 bp, Homo sapiens; identical to SEQ ID NO: 555156
  misc_feature: HIJSMM301BUXRV.3.79.H02.1.454.light.4.raw

SEQ ID NO: 580837 - DNA, 498 bp, Homo sapiens
  misc_feature: HIJSMM301DEOYO.48.53.E09.1.454.light.4.raw
agtatacatacacgaccggtgctcgatttagagagagtgtgttgggtttggggactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 580838 - DNA, 490 bp, Homo sapiens; identical to SEQ ID NO: 540910
  misc_feature: HIJSMM301BRQCU.40.12.B01.1.454.light.4.raw

SEQ ID NO: 580839 - DNA, 476 bp, Homo sapiens; identical to SEQ ID NO: 565964
  misc_feature: HIJSMM301DNTJU.43.12.B01.1.454.light.4.raw

SEQ ID NO: 580840 - DNA, 499 bp, Homo sapiens
  misc_feature: HIJSMM301AU2G1.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctccttcagacgttcggccaagggaccaaggtggaaatcaaacgaactgtggctgcacc

SEQ ID NO: 580841 - DNA, 499 bp, Homo sapiens
  misc_feature: HIJSMM301C9ENE.41.86.H09.1.454.light.4.raw
tctatactatcacgaccggtgctcgatttagtgctatagacttgggtttggggagtctcagtcaggacacagcatggacatgagggtccccgctcagctcctggggctcctgctactctggctccgaggtgtcagatgtgacatccaggtgacccagtctccaccctccctctctgctcttgtcggagacagggtcaccatctcttgccgggcatccccgagcgtcagcacctttttagcttggtatcaacaaaaaccaggggaagcccctaaactcctcatctacgatgcttctactttacaaattggggtctcaccgagattcagtggcagtgggtctgggacagacttcgctctcaccatcaccagtctgcaacctgaagatgtcggcacttatttctgtcagcagagttttagcacccctccgacgttcggcccagggactagggtgacaatcaacgaactgtggctgcaccatctgtcttcatcttcccgccat

SEQ ID NO: 580842 - DNA, 527 bp, Homo sapiens
  misc_feature: HIJSMM301AGV1L.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcacgcccaacggccaacccccactgtcactctcgttccccaccctccctccgtcgtc

SEQ ID NO: 580843 - DNA, 514 bp, Homo sapiens; identical to SEQ ID NO: 538153
  misc_feature: HIJSMM301EFSQ7.17.37.D04.1.454.light.4.raw

SEQ ID NO: 580844 - DNA, 523 bp, Homo sapiens
  misc_feature: HIJSMM301B8ITT.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctggggacagacttcactctcaccatcagcagcctagagcctgaagattttgcagtttattactgtcaacatcgtaccgagtggcctccgggggccactttcggccctcgggaccgaaacttagtaggatacaaacgaaacctagtggcgtgcgaccactctgtcttctatcttcccgtcccact

SEQ ID NO: 580845 - DNA, 502 bp, Homo sapiens; identical to SEQ ID NO: 537816
  misc_feature: HIJSMM301C1PG0.19.78.H01.1.454.light.4.raw

SEQ ID NO: 580846 - DNA, 488 bp, Homo sapiens; identical to SEQ ID NO: 536861
  misc_feature: HIJSMM301DHHDA.12.88.H11.1.454.light.4.raw

SEQ ID NO: 580847 - DNA, 501 bp, Homo sapiens; identical to SEQ ID NO: 536142
  misc_feature: HIJSMM301EUOFD.15.1.A01.1.454.light.4.raw

SEQ ID NO: 580848 - DNA, 502 bp, Homo sapiens; identical to SEQ ID NO: 553118
  misc_feature: HIJSMM301DB8VV.10.9.A09.1.454.light.4.raw

SEQ ID NO: 580849 - DNA, 473 bp, Homo sapiens
  misc_feature: HIJSMM301AJNDX.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcccccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaaatcaaacgaa

SEQ ID NO: 580850 - DNA, 504 bp, Homo sapiens
  misc_feature: HIJSMM301ATIOZ.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggccaaggtggacctcaaacgaactgtggctgcaccatctgtcttcatcttcccgcc

SEQ ID NO: 580851 - DNA, 465 bp, Homo sapiens; identical to SEQ ID NO: 538589
  misc_feature: HIJSMM301DJE0V.12.39.D06.1.454.light.4.raw

SEQ ID NO: 580852 - DNA, 485 bp, Homo sapiens; identical to SEQ ID NO: 543370
  misc_feature: HIJSMM301D186P.3.10.A10.1.454.light.4.raw

SEQ ID NO: 580853 - DNA, 485 bp, Homo sapiens; identical to SEQ ID NO: 535822
  misc_feature: HIJSMM301BL4PT.14.53.E09.1.454.light.4.raw

SEQ ID NO: 580854 - DNA, 481 bp, Homo sapiens
  misc_feature: HIJSMM301D8MUB.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggaggaccaaggtgagatcaaacgaa

SEQ ID NO: 580855 - DNA, 513 bp, Homo sapiens; identical to SEQ ID NO: 552442
  misc_feature: HIJSMM301BGD8F.47.85.H08.1.454.light.4.raw

SEQ ID NO: 580856 - DNA, 485 bp, Homo sapiens; identical to SEQ ID NO: 536576
  misc_feature: HIJSMM301CDVS9.46.35.D02.1.454.light.4.raw

SEQ ID NO: 580857 - DNA, 502 bp, Homo sapiens
  misc_feature: HIJSMM301D3LVT.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgatgctgattattactgtgtaggttgggatcgcagcctgactgcttacgtcttcggagctgggaccaaggtcaccgtcctagggcacgtgagactcaggaaatgaccagaggggagtgaatgagggtgcagagaactccatggctaccaggtcagcccaaggccaaccccactgtcactctgttcccaccctcctcta

SEQ ID NO: 580858 - DNA, 498 bp, Homo sapiens; identical to SEQ ID NO: 559536
  misc_feature: HIJSMM301BRWWD.40.57.F02.1.454.light.4.raw

SEQ ID NO: 580859 - DNA, 495 bp, Homo sapiens; identical to SEQ ID NO: 539836
  misc_feature: HIJSMM301CJPWJ.9.1.A01.1.454.light.4.raw

SEQ ID NO: 580860 - DNA, 494 bp, Homo sapiens
  misc_feature: HIJSMM301BW3Q5.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccgagggtggagatcaaacgaactgtggctgcaccatctgtcttcta

SEQ ID NO: 580861 - DNA, 454 bp, Homo sapiens; identical to SEQ ID NO: 535005
  misc_feature: HIJSMM301A188A.19.86.H09.1.454.light.4.raw

SEQ ID NO: 580862 - DNA, 493 bp, Homo sapiens; identical to SEQ ID NO: 544768
  misc_feature: HIJSMM301CL2SX.22.25.C03.1.454.light.4.raw

SEQ ID NO: 580863 - DNA, 486 bp, Homo sapiens; identical to SEQ ID NO: 537428
  misc_feature: HIJSMM301A0QVY.47.62.F07.1.454.light.4.raw

SEQ ID NO: 580864 - DNA, 503 bp, Homo sapiens; identical to SEQ ID NO: 538973
  misc_feature: HIJSMM301CH1SF.5.86.H09.1.454.light.4.raw

SEQ ID NO: 580865 - DNA, 484 bp, Homo sapiens; identical to SEQ ID NO: 537427
  misc_feature: HIJSMM301ESPVW.26.78.H01.1.454.light.4.raw

SEQ ID NO: 580866 - DNA, 497 bp, Homo sapiens; identical to SEQ ID NO: 536376
  misc_feature: HIJSMM301D7KYL.22.9.A09.1.454.light.4.raw

SEQ ID NO: 580867 - DNA, 521 bp, Homo sapiens
  misc_feature: HIJSMM301A2ESY.9.86.H09.1.454.light.4.raw
tgatacgtctcacgaccggtgctcgatttagtgctatagacttgggtttgggggggggtcgacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctccggtcactctgttcccaccctcct

SEQ ID NO: 580868 - DNA, 494 bp, Homo sapiens
  misc_feature: HIJSMM301AGYLB.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagttttttactgtcagcagtatagtaactggcctccgtacacttttggccaggggaccaagctagaatcaaacgaactgtggctgcaccatctgtcttcatt

SEQ ID NO: 580869 - DNA, 501 bp, Homo sapiens
  misc_feature: HIJSMM301B5EVC.15.1.A01.1.454.light.4.raw
tctacgtagccacgaccggtgctcgatttagacgtctcatcagggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctcctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 580870 - DNA, 506 bp, Homo sapiens
  misc_feature: HIJSMM301CZNVL.11.67.G01.1.454.light.4.raw
  modified_base (190)..(190): a, c, t, g, unknown or other
cgagagataccacgaccggtgctcgatttagagtatacatattgggtttggggggttgagaagacaggactcaggacaatctccagcatggccagcttccctctcctcctcaccctcctcactcactgtgcagggtcctgggcccagtctgttctgactcagccaccctcagcgtctgggacccccgggnagagaatcaccatctcttgtactggaagcagctccaatatcggaagtaacgatgtcaattggtatcaacatctcccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaaggctgaccgtcctgggtcagcccaaggctgccccctcggtcactcc

SEQ ID NO: 580871 - DNA, 494 bp, Homo sapiens; identical to SEQ ID NO: 534994
  misc_feature: HIJSMM301A3BNW.27.78.H01.1.454.light.4.raw

SEQ ID NO: 580872 - DNA, 486 bp, Homo sapiens; identical to SEQ ID NO: 535043
  misc_feature: HIJSMM301CD6LH.46.35.D02.1.454.light.4.raw

SEQ ID NO: 580873 - DNA, 484 bp, Homo sapiens; identical to SEQ ID NO: 535400
  misc_feature: HIJSMM301AGS15.46.26.C04.1.454.light.4.raw

SEQ ID NO: 580874 - DNA, 498 bp, Homo sapiens
  misc_feature: HIJSMM301BQX12.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccacccttctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgtt

SEQ ID NO: 580875 - DNA, 486 bp, Homo sapiens; identical to SEQ ID NO: 568099
  misc_feature: HIJSMM301DEYSC.26.45.E01.1.454.light.4.raw

SEQ ID NO: 580876 - DNA, 515 bp, Homo sapiens; identical to SEQ ID NO: 538805
  misc_feature: HIJSMM301AW8A0.14.19.B08.1.454.light.4.raw

SEQ ID NO: 580877 - DNA, 474 bp, Homo sapiens
  misc_feature: HIJSMM301EGR0N.5.15.B04.1.454.light.4.raw
atcagacacgcacgaccggtgctcgatttagacagtatatatccgcgggggtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtgggtcccaccaacgttcagcggcagtggatctgggacagaattcactctcaccatcagcagcctgcagcctgatgatgctgcaacttattactgtcaacaatataacagttattggacgttcggccaagggaccaaggtggaaatacaaacgaactgtggctgcacc

SEQ ID NO: 580878 - DNA, 495 bp, Homo sapiens
  misc_feature: HIJSMM301DEN42.11.81.H04.1.454.light.4.raw
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttactgtcagcagtatagtaactggcctccgtacacttttggtcaggggaccaagctagaaatcaaacgaactgtggctgcaccatctgtcttcta

SEQ ID NO: 580879 - DNA, 495 bp, Homo sapiens
  misc_feature: HIJSMM301C7L7L.27.78.H01.1.454.light.4.raw
agcgtcgtctcacgaccggtgctcgatttagtgtgagtagtttgggtttgggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 580880 - DNA, 518 bp, Homo sapiens; identical to SEQ ID NO: 540171
  misc_feature: HIJSMM301DJ9L2.49.10.A10.1.454.light.4.raw

SEQ ID NO: 580881 - DNA, 455 bp, Homo sapiens
  misc_feature: HIJSMM301DVL6V.5.86.H09.1.454.light.4.raw
atcagacacgcacgaccggtgctcgatttagtgctatagacttgggtttggggggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcattctgttcccaccctcctccgtgtctgat

SEQ ID NO: 580882 - DNA, 486 bp, Homo sapiens; identical to SEQ ID NO: 535290
  misc_feature: HIJSMM301BQ6F0.3.12.B01.1.454.light.4.raw

SEQ ID NO: 580883 - DNA, 494 bp, Homo sapiens; identical to SEQ ID NO: 536477
  misc_feature: HIJSMM301A3P35.22.5.A05.1.454.light.4.raw

SEQ ID NO: 580884 - DNA, 494 bp, Homo sapiens; identical to SEQ ID NO: 534994
  misc_feature: HIJSMM301BPHIS.27.78.H01.1.454.light.4.raw

SEQ ID NO: 580885 - DNA, 496 bp, Homo sapiens
  misc_feature: HIJSMM301EXZG9.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccaaggtggagatcaaacgaactagtggctgcaccatctgtcttcatcttcccgt

SEQ ID NO: 580886 - DNA, 497 bp, Homo sapiens
  misc_feature: HIJSMM301D1X1N.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatggcggtcggtttattattgtacaacaattattttagtgctccgtactacttttggccaggggaccaaggttggagatacaaacgaact

SEQ ID NO: 580887 - DNA, 481 bp, Homo sapiens; identical to SEQ ID NO: 535410
  misc_feature: HIJSMM301AH1UL.41.68.G02.1.454.light.4.raw

SEQ ID NO: 580888 - DNA, 454 bp, Homo sapiens; identical to SEQ ID NO: 534964
  misc_feature: HIJSMM301AO8MD.19.86.H09.1.454.light.4.raw

SEQ ID NO: 580889 - DNA, 502 bp, Homo sapiens
  misc_feature: HIJSMM301CFTDJ.48.37.D04.1.454.light.4.raw
agtatacatacacgaccggtgctcgatttagtagcatactgttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgtccccccg

SEQ ID NO: 580890 - DNA, 488 bp, Homo sapiens; identical to SEQ ID NO: 540827
  misc_feature: HIJSMM301CH34G.15.49.E05.1.454.light.4.raw

SEQ ID NO: 580891 - DNA, 502 bp, Homo sapiens; identical to SEQ ID NO: 536953
  misc_feature: HIJSMM301BIDJR.10.71.G05.1.454.light.4.raw

SEQ ID NO: 580892 - DNA, 508 bp, Homo sapiens
  misc_feature: HIJSMM301BZ4WN.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctcctgacaatctctgggctccaggctgaggacgaggctgattattactgctgctcatatgcagatggtgacactcccggtggtattcgggcggagggaccaaggtcgaccgtcctaggtcagcccaaggctcgtccccccg

SEQ ID NO: 580893 - DNA, 485 bp, Homo sapiens
  misc_feature: HIJSMM301BYFD3.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggcccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccagggaccaaggtacgaaatagagacgaactgtggctgcaccat

SEQ ID NO: 580894 - DNA, 483 bp, Homo sapiens
  misc_feature: HIJSMM301A9I4P.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggccccctatacttttggccagggaccaagctggagatcacaggaactgtgctgcacc

SEQ ID NO: 580895 - DNA, 441 bp, Homo sapiens
  misc_feature: HIJSMM301DI8N8.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaatcgtcctaggtcagcccaaggctgccccctcggtcactctgttcccaccctcctcgtatctctcg

SEQ ID NO: 580896 - DNA, 504 bp, Homo sapiens; identical to SEQ ID NO: 539091
  misc_feature: HIJSMM301CT0EA.8.28.C06.1.454.light.4.raw

SEQ ID NO: 580897 - DNA, 519 bp, Homo sapiens
  misc_feature: HIJSMM301D9DIT.41.28.C06.1.454.light.4.raw
tctatactatcacgaccggtgctcgatttagagctcacgtattgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccctcctc

SEQ ID NO: 580898 - DNA, 493 bp, Homo sapiens; identical to SEQ ID NO: 540127
  misc_feature: HIJSMM301A58D0.10.17.B06.1.454.light.4.raw

SEQ ID NO: 580899 - DNA, 501 bp, Homo sapiens; identical to SEQ ID NO: 535746
  misc_feature: HIJSMM301EUQSG.18.11.A11.1.454.light.4.raw

SEQ ID NO: 580900 - DNA, 498 bp, Homo sapiens; identical to SEQ ID NO: 535974
  misc_feature: HIJSMM301AVJVD.22.27.C05.1.454.light.4.raw

SEQ ID NO: 580901 - DNA, 497 bp, Homo sapiens; identical to SEQ ID NO: 545672
  misc_feature: HIJSMM301D2NLG.2.49.E05.1.454.light.4.raw

SEQ ID NO: 580902 - DNA, 506 bp, Homo sapiens; identical to SEQ ID NO: 554070
  misc_feature: HIJSMM301CK2Z9.15.5.A05.1.454.light.4.raw

SEQ ID NO: 580903 - DNA, 447 bp, Homo sapiens; identical to SEQ ID NO: 535020
  misc_feature: HIJSMM301AUYL0.18.9.A09.1.454.light.4.raw

SEQ ID NO: 580904 - DNA, 495 bp, Homo sapiens; identical to SEQ ID NO: 535596
  misc_feature: HIJSMM301CWMMP.10.79.H02.1.454.light.4.raw

SEQ ID NO: 580905 - DNA, 496 bp, Homo sapiens; identical to SEQ ID NO: 537925
  misc_feature: HIJSMM301ECRH9.22.14.B03.1.454.light.4.raw

SEQ ID NO: 580906 - DNA, 460 bp, Homo sapiens; identical to SEQ ID NO: 537107
  misc_feature: HIJSMM301ALJOE.22.28.C06.1.454.light.4.raw

SEQ ID NO: 580907 - DNA, 482 bp, Homo sapiens; identical to SEQ ID NO: 540508
  misc_feature: HIJSMM301EV521.43.64.F09.1.454.light.4.raw

SEQ ID NO: 580908 - DNA, 496 bp, Homo sapiens
  misc_feature: HIJSMM301B9XXA.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaccccgatcaccttcggccgaggacacgcctggagattaaacgaactgtggctgcaccat

SEQ ID NO: 580909 - DNA, 493 bp, Homo sapiens; identical to SEQ ID NO: 535278
  misc_feature: HIJSMM301EXGST.51.81.H04.1.454.light.4.raw

SEQ ID NO: 580910 - DNA, 513 bp, Homo sapiens
  misc_feature: HIJSMM301CE7VC.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaggtcagcccaaggctgccccctcggtcactctgttcccaccctcctcta

SEQ ID NO: 580911 - DNA, 503 bp, Homo sapiens
  misc_feature: HIJSMM301EG84C.19.78.H01.1.454.light.4.raw
tactctcgtgcacgaccggtgctcgatttagtgtgagtagtttgggtttgggggtcacaagaggcagcgctctcgggacgtctccgccatggcctgggctctgctgctcctcactctcctcactcaggacacagggtcctgggcccagtctgccctgactcagtctgcctccgtgtctgggtctcctggacagtaggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtca

SEQ ID NO: 580912 - DNA, 484 bp, Homo sapiens
  misc_feature: HIJSMM301EWL6R.4.41.D08.1.454.light.4.raw
agcactgtagcacgaccggtgctcgatttagtcacgcgagaaagggaaagggggagtcagacccagtcaggacacagcatggacatgagggtccccgctcagctcctgggctcctgctgctctggttcccaggttccagatgcgacatccagctgacccagtctccttctttcgtgtctgcgtctgtgagagacagacttactatcacttgtcgggcgagtcaggatattagtaccaacttagcctggtatcagcagaagcctgggcgagcccctaaactcctgatctatggtgcatcaagtctgcaaagtggggtcccatcgaggttcagaggcagtggatctgggacagatttcactctcaccatcagcggcctgcagcctgaagattatgcaacttactattgtcagagttctaattctttcccgcgcacgtttggccaggggaccaaggtagagatacaaacgaactgtggctgcaccat

SEQ ID NO: 580913 - DNA, 432 bp, Homo sapiens; identical to SEQ ID NO: 535811
  misc_feature: HIJSMM301DN2K2.14.5.A05.1.454.light.4.raw

SEQ ID NO: 580914 - DNA, 486 bp, Homo sapiens
  misc_feature: HIJSMM301CU5A2.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaa

SEQ ID NO: 580915 - DNA, 495 bp, Homo sapiens; identical to SEQ ID NO: 535007
  misc_feature: HIJSMM301ET656.22.5.A05.1.454.light.4.raw

SEQ ID NO: 580916 - DNA, 501 bp, Homo sapiens
  misc_feature: HIJSMM301CTYE5.48.73.G07.1.454.light.4.raw
agtatacatacacgaccggtgctcgatttagctctacgctcagggcacgaccggtgctcgatttagcactcgcacgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaacccg

SEQ ID NO: 580917 - DNA, 496 bp, Homo sapiens; identical to SEQ ID NO: 535109
  misc_feature: HIJSMM301EYBXH.16.78.H01.1.454.light.4.raw

SEQ ID NO: 580918 - DNA, 498 bp, Homo sapiens
  misc_feature: HIJSMM301C8GA7.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtagctcccgggacaacagtggtaaccatgtggtattcggcggagggaccaaactgaccgtcctaggtcagcccaaggctgccccctcggtcactctgtt

SEQ ID NO: 580919 - DNA, 512 bp, Homo sapiens
  misc_feature: HIJSMM301ADS89.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccgggatgaggccgactattactgtcaggtgtgggataatggtggtgatcatccggtcttcggcggagggaccaagttgaccgtcctaagtcagcccaaggctgccccctcggtcactctgttcccgccctcctcta

SEQ ID NO: 580920 - DNA, 521 bp, Homo sapiens; identical to SEQ ID NO: 539470
  misc_feature: HIJSMM301B05VW.27.23.C01.1.454.light.4.raw

SEQ ID NO: 580921 - DNA, 511 bp, Homo sapiens
  misc_feature: HIJSMM301DVY8Q.15.76.G10.1.454.light.4.raw
tctacgtagccacgaccggtgctcgatttagtcactcatacagggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgcctcccgctacgt

SEQ ID NO: 580922 - DNA, 497 bp, Homo sapiens
  misc_feature: HIJSMM301EOVSA.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggcctaggggaccaagctggagatcaaacgaactgtggctgcaa

SEQ ID NO: 580923 - DNA, 494 bp, Homo sapiens; identical to SEQ ID NO: 534992
  misc_feature: HIJSMM301D1XRU.9.1.A01.1.454.light.4.raw

SEQ ID NO: 580924 - DNA, 521 bp, Homo sapiens; identical to SEQ ID NO: 538715
  misc_feature: HIJSMM301AKEQJ.27.23.C01.1.454.light.4.raw

SEQ ID NO: 580925 - DNA, 446 bp, Homo sapiens
  misc_feature: HIJSMM301B5SFN.18.9.A09.1.454.light.4.raw
  modified_base (428)..(428): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccnccctcctccatactcgta

SEQ ID NO: 580926 - DNA, 516 bp, Homo sapiens
  misc_feature: HIJSMM301BWDHM.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtcctaggtcagcccaaggctgccccctcggtcactctgttcccaccctcctcgacacgcg

SEQ ID NO: 580927 - DNA, 502 bp, Homo sapiens; identical to SEQ ID NO: 541971
  misc_feature: HIJSMM301BXQEK.4.39.D06.1.454.light.4.raw

SEQ ID NO: 580928 - DNA, 354 bp, Homo sapiens; identical to SEQ ID NO: 535026
  misc_feature: HIJSMM301DJ7M2.19.22.B11.1.454.light.4.raw

SEQ ID NO: 580929 - DNA, 502 bp, Homo sapiens
  misc_feature: HIJSMM301DPN3N.48.26.C04.1.454.light.4.raw
agtatacatacacgaccggtgctcgatttagtctagcgactttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgcccctcggt

SEQ ID NO: 580930 - DNA, 486 bp, Homo sapiens; identical to SEQ ID NO: 547872
  misc_feature: HIJSMM301BL0PW.14.55.E11.1.454.light.4.raw

SEQ ID NO: 580931 - DNA, 489 bp, Homo sapiens
  misc_feature: HIJSMM301CWYBX.17.21.B10.1.454.light.4.raw
  modified_base (481)..(481): a, c, t, g, unknown or other
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcgggtttactactgcatgcagggtacactctggccgttcacttttggccaggggaccaaactggatatcagacgaactntggctgca

SEQ ID NO: 580932 - DNA, 502 bp, Homo sapiens
  misc_feature: HIJSMM301D7J0E.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccgaggtcaccgtcctaggtcagcccaaggccaaccca

SEQ ID NO: 580933 - DNA, 490 bp, Homo sapiens; identical to SEQ ID NO: 562759
  misc_feature: HIJSMM301BRJD7.19.71.G05.1.454.light.4.raw

SEQ ID NO: 580934 - DNA, 521 bp, Homo sapiens
  misc_feature: HIJSMM301A3XGV.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctcgttcccaccctcct

SEQ ID NO: 580935 - DNA, 509 bp, Homo sapiens
  misc_feature: HIJSMM301DPKHE.52.72.G06.1.454.light.4.raw
  modified_base (450)..(450): a, c, t, g, unknown or other
cgcagtacgacacgaccggtgctcgatttagctacgactgcaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttgggngttcggcggcgggaccaaactgaccgtcctacgtcagcccaaggctgccccctcggtca

SEQ ID NO: 580936 - DNA, 500 bp, Homo sapiens; identical to SEQ ID NO: 546615
  misc_feature: HIJSMM301CZCMA.15.37.D04.1.454.light.4.raw

SEQ ID NO: 580937 - DNA, 485 bp, Homo sapiens
  misc_feature: HIJSMM301EGGD7.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 580938 - DNA, 493 bp, Homo sapiens; identical to SEQ ID NO: 536246
  misc_feature: HIJSMM301DKCXG.49.66.F11.1.454.light.4.raw

SEQ ID NO: 580939 - DNA, 487 bp, Homo sapiens; identical to SEQ ID NO: 549649
  misc_feature: HIJSMM301A59CC.19.71.G05.1.454.light.4.raw

SEQ ID NO: 580940 - DNA, 498 bp, Homo sapiens
  misc_feature: HIJSMM301B9EW8.40.34.D01.1.454.light.4.raw
tctagcgactcacgaccggtgctcgatttagatcgtctgtgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctgaccgtcctacgtcagcccaaggctccg

SEQ ID NO: 580941 - DNA, 493 bp, Homo sapiens; identical to SEQ ID NO: 544335
  misc_feature: HIJSMM301B360H.5.57.F02.1.454.light.4.raw

SEQ ID NO: 580942 - DNA, 510 bp, Homo sapiens; identical to SEQ ID NO: 580611
  misc_feature: HIJSMM301E0LVW.17.2.A02.1.454.light.4.raw

SEQ ID NO: 580943 - DNA, 498 bp, Homo sapiens
  misc_feature: HIJSMM301EPO9F.10.72.G06.1.454.light.4.raw
catagtagtgcacgaccggtgctcgatttagctacgactgcaaggggaaaggggggggtcgtcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccacggcccccacgactcatcatttctgatgtcagtgatcggccctttgggtatttctaatcgcttctctgcctccaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 580944 - DNA, 486 bp, Homo sapiens
  misc_feature: HIJSMM301CXMTZ.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgcaggttcagtgccagtgggtctgggacagagttcactctcaccatcagcagcctgcagtctgaagattttgcactttattactgtcagcaatataatgactggttctcgatcaccttcggccaagggacacgactggagattaaacgaactgtggctgcaccatctgtt

SEQ ID NO: 580945 - DNA, 485 bp, Homo sapiens; identical to SEQ ID NO: 535606
  misc_feature: HIJSMM301CN96I.47.46.E02.1.454.light.4.raw

SEQ ID NO: 580946 - DNA, 483 bp, Homo sapiens; identical to SEQ ID NO: 545669
  misc_feature: HIJSMM301BW4ZU.13.8.A08.1.454.light.4.raw

SEQ ID NO: 580947 - DNA, 492 bp, Homo sapiens
  misc_feature: HIJSMM301DNC2Z.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgacatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacacgtacccccctcactttcggcggagggaccaaggcggagatcagacgaactgtggctgcaccatctgtcttcta

SEQ ID NO: 580948 - DNA, 513 bp, Homo sapiens
  misc_feature: HIJSMM301CRJD1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgttcaacagttttctcgggtcgttcggtccaagggaccgaaggtggaaagtacaaaacgaactacgtggcctgcaccactctgtcttcatcttccccg

SEQ ID NO: 580949 - DNA, 487 bp, Homo sapiens; identical to SEQ ID NO: 536206
  misc_feature: HIJSMM301B5C4G.47.38.D05.1.454.light.4.raw

SEQ ID NO: 580950 - DNA, 503 bp, Homo sapiens
  misc_feature: HIJSMM301AIU50.48.23.C01.1.454.light.4.raw
agtatacatacacgaccggtgctcgatttagtacacgtgattagggattgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgactgtggctgcaccatctgtcttcatcttccccg

SEQ ID NO: 580951 - DNA, 490 bp, Homo sapiens; identical to SEQ ID NO: 542396
  misc_feature: HIJSMM301DI03U.16.53.E09.1.454.light.4.raw

SEQ ID NO: 580952 - DNA, 497 bp, Homo sapiens; identical to SEQ ID NO: 568167
  misc_feature: HIJSMM301BV8OM.3.33.C11.1.454.light.4.raw

SEQ ID NO: 580953 - DNA, 517 bp, Homo sapiens
  misc_feature: HIJSMM301BN8CS.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgagggaccgaacggtaggaagtacgaaacgaactagtggcgtgcaccactctgtcttctactcttcccgtcccact

SEQ ID NO: 580954 - DNA, 497 bp, Homo sapiens
  misc_feature: HIJSMM301E35EG.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccgagggaccgaaacctaggagtaatcagacgaactacgtggtctg

SEQ ID NO: 580955 - DNA, 513 bp, Homo sapiens; identical to SEQ ID NO: 545752
  misc_feature: HIJSMM301DWCH4.17.33.C11.1.454.light.4.raw

SEQ ID NO: 580956 - DNA, 513 bp, Homo sapiens; identical to SEQ ID NO: 568756
  misc_feature: HIJSMM301BSDDG.13.81.H04.1.454.light.4.raw

SEQ ID NO: 580957 - DNA, 506 bp, Homo sapiens
  misc_feature: HIJSMM301B26HQ.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccactgt

SEQ ID NO: 580958 - DNA, 480 bp, Homo sapiens
  misc_feature: HIJSMM301DF7L7.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagatttgcggttattactgtcagcagtatgataactggctgtacacttttggccaggggaccaagctggagatcaggcgaactgtggctgca

SEQ ID NO: 580959 - DNA, 498 bp, Homo sapiens
  misc_feature: HIJSMM301BK9BY.3.33.C11.1.454.light.4.raw
agacgcactccacgaccggtgctcgatttagagtgagctcgttggggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccccg

SEQ ID NO: 580960 - DNA, 497 bp, Homo sapiens
  misc_feature: HIJSMM301C41KV.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaa

SEQ ID NO: 580961 - DNA, 403 bp, Homo sapiens
  misc_feature: HIJSMM301DAO6L.49.87.H10.1.454.light.4.raw
agtcgagagacacgaccggtgctcgatttagcagtactgcgttgggtttggggagttggtagatgcccctctgggagagatccccaggggtgacagccatggaccctggaagggcctgggctagggacagggaccagagccagtccagggagaggacagagccaatggactggggtgtactgtaacagccctgctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttcccgccctcctctctctcgact

SEQ ID NO: 580962 - DNA, 494 bp, Homo sapiens; identical to SEQ ID NO: 534992
  misc_feature: HIJSMM301EU0DW.9.1.A01.1.454.light.4.raw

SEQ ID NO: 580963 - DNA, 499 bp, Homo sapiens; identical to SEQ ID NO: 571545
  misc_feature: HIJSMM301DHRJR.11.67.G01.1.454.light.4.raw

SEQ ID NO: 580964 - DNA, 489 bp, Homo sapiens; identical to SEQ ID NO: 544582
  misc_feature: HIJSMM301DG4UG.22.65.F10.1.454.light.4.raw

SEQ ID NO: 580965 - DNA, 493 bp, Homo sapiens
  misc_feature: HIJSMM301BFFQK.48.37.D04.1.454.light.4.raw
agtatacatacacgaccggtgctcgatttagtagcatactgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgtccccccg

SEQ ID NO: 580966 - DNA, 497 bp, Homo sapiens
  misc_feature: HIJSMM301DOGGO.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccca

SEQ ID NO: 580967 - DNA, 505 bp, Homo sapiens; identical to SEQ ID NO: 539292
  misc_feature: HIJSMM301EFQDY.19.85.H08.1.454.light.4.raw

SEQ ID NO: 580968 - DNA, 501 bp, Homo sapiens; identical to SEQ ID NO: 536142
  misc_feature: HIJSMM301AMR7M.15.1.A01.1.454.light.4.raw

SEQ ID NO: 580969 - DNA, 503 bp, Homo sapiens; identical to SEQ ID NO: 538884
  misc_feature: HIJSMM301D9M4I.27.78.H01.1.454.light.4.raw

SEQ ID NO: 580970 - DNA, 503 bp, Homo sapiens
  misc_feature: HIJSMM301AMIBZ.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcacgcccaaggcc

SEQ ID NO: 580971 - DNA, 499 bp, Homo sapiens
  misc_feature: HIJSMM301CBSFU.48.37.D04.1.454.light.4.raw
agtatacatacacgaccggtgctcgatttagtagcatactgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtca

SEQ ID NO: 580972 - DNA, 494 bp, Homo sapiens; identical to SEQ ID NO: 538230
  misc_feature: HIJSMM301BFSYY.11.71.G05.1.454.light.4.raw

SEQ ID NO: 580973 - DNA, 422 bp, Homo sapiens
  misc_feature: HIJSMM301B2V1P.41.13.B02.1.454.light.4.raw
tctatactatcacgaccggtgctcgatttagtctagcgacttccgcgggcacgaccggtgctcgatttagtacgctgtctttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 580974 - DNA, 484 bp, Homo sapiens; identical to SEQ ID NO: 559857
  misc_feature: HIJSMM301ECI8A.12.8.A08.1.454.light.4.raw

SEQ ID NO: 580975 - DNA, 504 bp, Homo sapiens
  misc_feature: HIJSMM301C4OFT.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggccctgggaccaaagtggatatcaaacgaactgtggctgcaccatctgtctt

SEQ ID NO: 580976 - DNA, 486 bp, Homo sapiens; identical to SEQ ID NO: 535043
  misc_feature: HIJSMM301DQ11F.46.35.D02.1.454.light.4.raw

SEQ ID NO: 580977 - DNA, 504 bp, Homo sapiens
  misc_feature: HIJSMM301A8KWC.48.38.D05.1.454.light.4.raw
agtatacatacacgaccggtgctcgatttagtatctgatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttccccg

SEQ ID NO: 580978 - DNA, 510 bp, Homo sapiens; identical to SEQ ID NO: 553863
  misc_feature: HIJSMM301A6FB0.16.46.E02.1.454.light.4.raw

SEQ ID NO: 580979 - DNA, 514 bp, Homo sapiens
  misc_feature: HIJSMM301DKQGS.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctgttcccgccctcctcg

SEQ ID NO: 580980 - DNA, 496 bp, Homo sapiens; identical to SEQ ID NO: 538149
  misc_feature: HIJSMM301B77O9.13.67.G01.1.454.light.4.raw

SEQ ID NO: 580981 - DNA, 494 bp, Homo sapiens; identical to SEQ ID NO: 534992
  misc_feature: HIJSMM301EORBJ.9.1.A01.1.454.light.4.raw

SEQ ID NO: 580982 - DNA, 520 bp, Homo sapiens; identical to SEQ ID NO: 546218
  misc_feature: HIJSMM301EC5VG.12.71.G05.1.454.light.4.raw

SEQ ID NO: 580983 - DNA, 521 bp, Homo sapiens
  misc_feature: HIJSMM301ECVF4.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactttgttccctaccctccctcctacg

SEQ ID NO: 580984 - DNA, 495 bp, Homo sapiens; identical to SEQ ID NO: 547449
  misc_feature: HIJSMM301EI1O8.52.34.D01.1.454.light.4.raw

SEQ ID NO: 580985 - DNA, 486 bp, Homo sapiens
  misc_feature: HIJSMM301B09RU.43.54.E10.1.454.light.4.raw
tgtgagtagtcacgaccggtgctcgatttagatcgtagcagaacacacaaagggggatcaggactcctcagttcaccttctcacaatgaggctccctgctcagctcctggggctgctaatgctctcgggtcccaggatccattggggatattgtgctgactcagtctccactctccctctccgtcacccttggacagtcggtgtccatctcctgcaggtctagtcacagcgtcctacacagtgatggaagaacctacttggattggtttcagcagaggccaggccaatctccaaggctcctaatttataaggtttctagtcgggactctggggtcccagacagattcagcggcagtgggtcaggcactgacttcacactgaaaatcagtagtgtggaggctgaggatgttgccatttattactgcatgcaagggacacactggccgtacacttttggccaggggaccaagctggagatcaaacgaa

SEQ ID NO: 580986 - DNA, 492 bp, Homo sapiens; identical to SEQ ID NO: 580589
  misc_feature: HIJSMM301AIDXJ.14.36.D03.1.454.light.4.raw

SEQ ID NO: 580987 - DNA, 498 bp, Homo sapiens
  misc_feature: HIJSMM301EQ5ZE.49.73.G07.1.454.light.4.raw
agtcgagagacacgaccggtgctcgatttagctctacgctcagggcacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgctagtttattactgtcaacagcgtaccacaggattcactttcggccctgggaccagagtggatatacaaacgaa

SEQ ID NO: 580988 - DNA, 522 bp, Homo sapiens
  misc_feature: HIJSMM301AH5DL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccggggctccagcctgaggacgaggctgattattattgtagttcatatacaaccagtgacacttgggtgttcggcggagggaccaggctgaccgtcctaggtcagcccaaggctgccccctcggtcactctgttcccgccct

SEQ ID NO: 580989 - DNA, 496 bp, Homo sapiens
  misc_feature: HIJSMM301AG80Z.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactcttaccatcagcagcctagagcctgaagattttgcagtttattactgtcagcagcgtagcaactccctcacgttcggcggagggaccaaggtggagatcaaacgaactgtggctgcaccatctgtcttcatcttcccgcat

SEQ ID NO: 580990 - DNA, 504 bp, Homo sapiens; identical to SEQ ID NO: 535561
  misc_feature: HIJSMM301D9WN1.4.57.F02.1.454.light.4.raw

SEQ ID NO: 580991 - DNA, 481 bp, Homo sapiens
  misc_feature: HIJSMM301EWKMV.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctagcagcctgaagattttgcaacttactattgtcaacaggctaacagtttcccgctcaccttcggcgggggaccgaaggtggaggatcaaacgaactgtggctgcacc

SEQ ID NO: 580992 - DNA, 488 bp, Homo sapiens
  misc_feature: HIJSMM301CIECR.51.77.G11.1.454.light.4.raw
cgatcgtatacacgaccggtgctcgatttagctagtcactcaagggaaaggggagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggaggaccaaggtggacctcaaacgaactgtggctgcaccatctgtctt

SEQ ID NO: 580993 - DNA, 501 bp, Homo sapiens; identical to SEQ ID NO: 536867
  misc_feature: HIJSMM301C651D.5.86.H09.1.454.light.4.raw

SEQ ID NO: 580994 - DNA, 493 bp, Homo sapiens
  misc_feature: HIJSMM301EBXZV.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctaaagatatatgagacttctactttagaaagtgggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcta

SEQ ID NO: 580995 - DNA, 492 bp, Homo sapiens
  misc_feature: HIJSMM301DFGGA.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctggacttttggccagggaccaagctggagatcaacgaactgtggctgcaccatctgtctt

SEQ ID NO: 580996 - DNA, 488 bp, Homo sapiens; identical to SEQ ID NO: 540342
  misc_feature: HIJSMM301AYPPH.43.33.C11.1.454.light.4.raw

SEQ ID NO: 580997 - DNA, 497 bp, Homo sapiens
  misc_feature: HIJSMM301AX4L1.43.49.E05.1.454.light.4.raw
tgtgagtagtcacgaccggtgctcgatttagagcgactagcaacacacaaagggggaagagctgctcagttaggacccagagggaaccatggaaaccccagcgcagcttctcttcctcctgctactctggctcccagataccaccggagaaattgtgttgacgcagtctccaggcaccgtgtctttgtctccaggggaaagagccaccttctcttgcagggccagtcagagtgttagcagcaactacttagcctggtaccagcagaaacctggccaggctcccaggctcctcatctatggtgcatccaccagggccactggcatcccagacagattcagtggcactgggtctgggacagacttcactctcaccatcagcagactggaacctgaagattttgcaatttattactgtcagcagtatgcctggtcgcctccggccctcactttcggcggagggaccaaggtggagatcaaacgaactgtggctgcaccta

SEQ ID NO: 580998 - DNA, 479 bp, Homo sapiens; identical to SEQ ID NO: 543959
  misc_feature: HIJSMM301DHJH0.11.11.A11.1.454.light.4.raw

SEQ ID NO: 580999 - DNA, 473 bp, Homo sapiens; identical to SEQ ID NO: 556360
  misc_feature: HIJSMM301A1GIF.48.75.G09.1.454.light.4.raw

SEQ ID NO: 581000 - DNA, 503 bp, Homo sapiens
  misc_feature: HIJSMM301DQT81.53.37.D04.1.454.light.4.raw
cgcgtatacacacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtcactctcg

SEQ ID NO: 581001 - DNA, 506 bp, Homo sapiens
  misc_feature: HIJSMM301EPOME.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaacccccactgtcactctgttcccgccctt

SEQ ID NO: 581002 - DNA, 502 bp, Homo sapiens
  misc_feature: HIJSMM301B57HD.19.85.H08.1.454.light.4.raw
tactctcgtgcacgaccggtgctcgatttagtatcactcagtcgcggggctccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggacaccagcctcgctgcttggcttttcggcggaggaccaagctgaccgtcctgggtcagcccaaggctgccccctcggt

SEQ ID NO: 581003 - DNA, 503 bp, Homo sapiens; identical to SEQ ID NO: 536834
  misc_feature: HIJSMM301AQCYT.2.35.D02.1.454.light.4.raw

SEQ ID NO: 581004 - DNA, 503 bp, Homo sapiens; identical to SEQ ID NO: 539976
  misc_feature: HIJSMM301CY593.47.55.E11.1.454.light.4.raw

SEQ ID NO: 581005 - DNA, 505 bp, Homo sapiens
  misc_feature: HIJSMM301CIATK.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctacgctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggagtcaagcgaactgtggctgcaccatctgtcttcatcttcccgcc

SEQ ID NO: 581006 - DNA, 472 bp, Homo sapiens; identical to SEQ ID NO: 536302
  misc_feature: HIJSMM301BGB9T.18.76.G10.1.454.light.4.raw

SEQ ID NO: 581007 - DNA, 502 bp, Homo sapiens; identical to SEQ ID NO: 543913
  misc_feature: HIJSMM301ENO6C.18.26.C04.1.454.light.4.raw

SEQ ID NO: 581008 - DNA, 512 bp, Homo sapiens
  misc_feature: HIJSMM301DXBU8.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctggtcagcccaaggctgccccctcggtcactctgttcccaccct

SEQ ID NO: 581009 - DNA, 522 bp, Homo sapiens
  misc_feature: HIJSMM301DFRCD.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactatttctgtcaagtgtgggacaccaacacttgtgtcttcgggactgggaccgaggtcaccgtcctaagtcagcccagggccaaccccactcgtcactctgttccccaccctccctcgaccacg

SEQ ID NO: 581010 - DNA, 489 bp, Homo sapiens; identical to SEQ ID NO: 535139
  misc_feature: HIJSMM301D22ZZ.14.55.E11.1.454.light.4.raw

SEQ ID NO: 581011 - DNA, 486 bp, Homo sapiens; identical to SEQ ID NO: 561506
  misc_feature: HIJSMM301CDT2J.4.57.F02.1.454.light.4.raw

SEQ ID NO: 581012 - DNA, 492 bp, Homo sapiens; identical to SEQ ID NO: 534967
  misc_feature: HIJSMM301BNEBB.47.64.F09.1.454.light.4.raw

SEQ ID NO: 581013 - DNA, 484 bp, Homo sapiens; identical to SEQ ID NO: 536162
  misc_feature: HIJSMM301DHMC5.13.59.F04.1.454.light.4.raw

SEQ ID NO: 581014 - DNA, 500 bp, Homo sapiens
  misc_feature: HIJSMM301ETSPP.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcgggcggagggaccaagctgacgtcctgggtcagccaggctgcccctcggtca

SEQ ID NO: 581015 - DNA, 512 bp, Homo sapiens
  misc_feature: HIJSMM301C6JI5.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctagatcagcccaaggctgccccctcggtcactctgttccccg

SEQ ID NO: 581016 - DNA, 520 bp, Homo sapiens; identical to SEQ ID NO: 535686
  misc_feature: HIJSMM301AK180.41.19.B08.1.454.light.4.raw

SEQ ID NO: 581017 - DNA, 487 bp, Homo sapiens; identical to SEQ ID NO: 537009
  misc_feature: HIJSMM301DKZ08.12.88.H11.1.454.light.4.raw

SEQ ID NO: 581018 - DNA, 454 bp, Homo sapiens; identical to SEQ ID NO: 534964
  misc_feature: HIJSMM301A0ZNS.19.86.H09.1.454.light.4.raw

SEQ ID NO: 581019 - DNA, 485 bp, Homo sapiens; identical to SEQ ID NO: 572291
  misc_feature: HIJSMM301DAKY5.26.60.F05.1.454.light.4.raw

SEQ ID NO: 581020 - DNA, 484 bp, Homo sapiens; identical to SEQ ID NO: 556978
  misc_feature: HIJSMM301CY6B0.15.28.C06.1.454.light.4.raw

SEQ ID NO: 581021 - DNA, 512 bp, Homo sapiens
  misc_feature: HIJSMM301EJPON.48.33.C11.1.454.light.4.raw
agtatacatacacgaccggtgctcgatttagagtgagctcgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttcccaccct

SEQ ID NO: 581022 - DNA, 464 bp, Homo sapiens
  misc_feature: HIJSMM301CUUSM.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcgcagagttcactctcaccatcagcaccctgcagcctgaagattttgcgacttatttctgtctacaagattctaattaccctcggacgttcggccagggaccaagtggatgtcaaccgaa

SEQ ID NO: 581023 - DNA, 498 bp, Homo sapiens
  misc_feature: HIJSMM301CLOFX.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtcc

SEQ ID NO: 581024 - DNA, 518 bp, Homo sapiens
  misc_feature: HIJSMM301A4NQI.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggccaaggctgaccgtcctaggtcagcccaaggctgccccctcggtcactctgttcccaccctcctcacg

SEQ ID NO: 581025 - DNA, 484 bp, Homo sapiens; identical to SEQ ID NO: 535400
  misc_feature: HIJSMM301AHHN5.46.26.C04.1.454.light.4.raw

SEQ ID NO: 581026 - DNA, 497 bp, Homo sapiens; identical to SEQ ID NO: 536376
  misc_feature: HIJSMM301CKGPT.22.9.A09.1.454.light.4.raw

SEQ ID NO: 581027 - DNA, 498 bp, Homo sapiens; identical to SEQ ID NO: 544855
  misc_feature: HIJSMM301B57WA.18.59.F04.1.454.light.4.raw

SEQ ID NO: 581028 - DNA, 507 bp, Homo sapiens
  misc_feature: HIJSMM301D6HXO.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttcncggggcttcggccaacgggaccaaggtaggaaatacaaacgaactagtggctgcaccatctgtcttcatcttccccg

SEQ ID NO: 581029 - DNA, 354 bp, Homo sapiens; identical to SEQ ID NO: 540485
  misc_feature: HIJSMM301AGJ60.40.9.A09.1.454.light.4.raw

SEQ ID NO: 581030 - DNA, 511 bp, Homo sapiens
  misc_feature: HIJSMM301EK5JO.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcgtccaagggaccgaacggtaggacgatcaagacgaactagtggctgcaccactctgtcttctatcttcccgtcccact

SEQ ID NO: 581031 - DNA, 504 bp, Homo sapiens
  misc_feature: HIJSMM301EM79F.19.78.H01.1.454.light.4.raw
tactctcgtgcacgaccggtgctcgatttagtgtgagtagtttgggtttggggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcgtagtcagcccaacggccaaccccactg

SEQ ID NO: 581032 - DNA, 499 bp, Homo sapiens; identical to SEQ ID NO: 543887
  misc_feature: HIJSMM301DGXC6.10.65.F10.1.454.light.4.raw

SEQ ID NO: 581033 - DNA, 491 bp, Homo sapiens
  misc_feature: HIJSMM301B0E7Z.21.65.F10.1.454.light.4.raw
tcgtcgctcgcacgaccggtgctcgatttagctacgctctaaggggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtggaaagtcaaacgaactgtggctgcaccatctgtcttcta

SEQ ID NO: 581034 - DNA, 493 bp, Homo sapiens
  misc_feature: HIJSMM301DXV9L.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgttcggccaagggaccaaggtaggaaagtacaaacgaactagtggctgcaccatctgtcttcta

SEQ ID NO: 581035 - DNA, 504 bp, Homo sapiens
  misc_feature: HIJSMM301EAQQB.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggagggaccaaggtgaccgtcctaggtcagcccaaggctgcccccc

SEQ ID NO: 581036 - DNA, 479 bp, Homo sapiens; identical to SEQ ID NO: 538734
  misc_feature: HIJSMM301EHJNQ.8.53.E09.1.454.light.4.raw

SEQ ID NO: 581037 - DNA, 506 bp, Homo sapiens
  misc_feature: HIJSMM301AIJQN.7.31.C09.1.454.light.4.raw
cgtgtctctacacgaccggtgctcgatttagacgtctcatcaaggaaggaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaagctgaccgtcctaggtcacgcccaaggctcgccccctc

SEQ ID NO: 581038 - DNA, 521 bp, Homo sapiens; identical to SEQ ID NO: 538715
  misc_feature: HIJSMM301A7MHJ.27.23.C01.1.454.light.4.raw

SEQ ID NO: 581039 - DNA, 495 bp, Homo sapiens
  misc_feature: HIJSMM301CHRY8.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacaacagcgtggtgttcgggcggagggaccagtctgaccgtcttaggtcagcccaaggtccg

SEQ ID NO: 581040 - DNA, 506 bp, Homo sapiens
  misc_feature: HIJSMM301DC1HV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaagggaccgaaggtggaaatcaaacgaaactgtggctgcaccatctgtcttcatcttccccg

SEQ ID NO: 581041 - DNA, 501 bp, Homo sapiens
  misc_feature: HIJSMM301AHG3K.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccca

SEQ ID NO: 581042 - DNA, 503 bp, Homo sapiens
  misc_feature: HIJSMM301A9CN7.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactagtggctgcaccatctgt

SEQ ID NO: 581043 - DNA, 492 bp, Homo sapiens; identical to SEQ ID NO: 541409
  misc_feature: HIJSMM301BU6IQ.48.35.D02.1.454.light.4.raw

SEQ ID NO: 581044 - DNA, 496 bp, Homo sapiens; identical to SEQ ID NO: 537925
  misc_feature: HIJSMM301B2YL9.22.14.B03.1.454.light.4.raw

SEQ ID NO: 581045 - DNA, 484 bp, Homo sapiens; identical to SEQ ID NO: 535240
  misc_feature: HIJSMM301CM2MK.47.60.F05.1.454.light.4.raw

SEQ ID NO: 581046 - DNA, 513 bp, Homo sapiens
  misc_feature: HIJSMM301DMYWD.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccgacgggaccgacacgtagaaagtagagacgaactacgtggcgtgcaccatctgtcttctactcttcccgt

SEQ ID NO: 581047 - DNA, 504 bp, Homo sapiens
  misc_feature: HIJSMM301DZIQX.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaaatatgctcggtggttccagcagaagccaggccaggccccacgtactggtgatttataaagacattgagcggccctcagggagtccctcgagcgattctccggctctaattcagggaccgacagtcaccttgaccatcaccggggcccagattgaggatgaggctgactatattgttactctgcggctgacaaccatctggttttcggcgggggaccaagttgaccgtccgtgggtcagcccaaggctgccccctcggtcactctcg

SEQ ID NO: 581048 - DNA, 514 bp, Homo sapiens; identical to SEQ ID NO: 541418
  misc_feature: HIJSMM301CZ204.17.33.C11.1.454.light.4.raw

SEQ ID NO: 581049 - DNA, 498 bp, Homo sapiens; identical to SEQ ID NO: 535469
  misc_feature: HIJSMM301EQ7ZA.12.18.B07.1.454.light.4.raw

SEQ ID NO: 581050 - DNA, 510 bp, Homo sapiens
  misc_feature: HIJSMM301D6HGJ.22.65.F10.1.454.light.4.raw
  modified_base (487)..(487): a, c, t, g, unknown or other
  modified_base (497)..(497): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaaggttcagtggcagtggatctgggacagatttcactctcaccatccgcggtctgcaacctgaagatttcgcaacttactactgtcaaacagacttacagtgccccccccgactcaccttcggtccgaacgggaacgacgaactggagaagttaaagtaaacagtgcgtncgaccaactntcgtcttcctatt

SEQ ID NO: 581051 - DNA, 496 bp, Homo sapiens
  misc_feature: HIJSMM301A2PTL.22.57.F02.1.454.light.4.raw
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctgggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactgtggctgcaccatctgtcttcatt

SEQ ID NO: 581052 - DNA, 494 bp, Homo sapiens; identical to SEQ ID NO: 534994
  misc_feature: HIJSMM301A7Z3T.27.78.H01.1.454.light.4.raw

SEQ ID NO: 581053 - DNA, 494 bp, Homo sapiens; identical to SEQ ID NO: 535276
  misc_feature: HIJSMM301B8NOJ.16.6.A06.1.454.light.4.raw

SEQ ID NO: 581054 - DNA, 510 bp, Homo sapiens
  misc_feature: HIJSMM301CSYJJ.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtggaagtacaagacgaactacgtggcgtgcaccatctgtccttctactcttcccgt

SEQ ID NO: 581055 - DNA, 500 bp, Homo sapiens
  misc_feature: HIJSMM301C24J5.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaagctgccccctcggtcact

SEQ ID NO: 581056 - DNA, 521 bp, Homo sapiens
  misc_feature: HIJSMM301EAHTJ.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgtttcggcggcgggaccaaagtgaccgtcctaagtcagcccaaggctgccccctcggtcactctgttcccgccct

SEQ ID NO: 581057 - DNA, 506 bp, Homo sapiens
  misc_feature: HIJSMM301AVQLQ.16.1.A01.1.454.light.4.raw
tgtactactccacgaccggtgctcgatttagacgtctcatcaggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggcactctgtt

SEQ ID NO: 581058 - DNA, 508 bp, Homo sapiens; identical to SEQ ID NO: 552490
  misc_feature: HIJSMM301DY7VK.17.41.D08.1.454.light.4.raw

SEQ ID NO: 581059 - DNA, 505 bp, Homo sapiens
  misc_feature: HIJSMM301DPA1F.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtgggtcccatcaaggttcagtggcactggatctgggacagatttcactctcaccatcagcagtctgcaacctgaagattttgcaacttattactgtcaacagagtttcagtacgcggacgttcggtccaagggaccgaaggtggaaagtacaaacgaactacgtggctgcaccatctgtcttctatcttccccg

SEQ ID NO: 581060 - DNA, 484 bp, Homo sapiens; identical to SEQ ID NO: 537878
  misc_feature: HIJSMM301CWU5S.17.34.D01.1.454.light.4.raw

SEQ ID NO: 581061 - DNA, 523 bp, Homo sapiens
  misc_feature: HIJSMM301EHD5L.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcaaggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcgggggaccaaggtgaccgtcctaagtcagcccaaggctgccccctcggtcactctgttcccgccctcctcacg

SEQ ID NO: 581062 - DNA, 503 bp, Homo sapiens; identical to SEQ ID NO: 547049
  misc_feature: HIJSMM301A8VKT.18.59.F04.1.454.light.4.raw

SEQ ID NO: 581063 - DNA, 491 bp, Homo sapiens
  misc_feature: HIJSMM301A760Q.14.55.E11.1.454.light.4.raw
  modified_base (490)..(490): a, c, t, g, unknown or other
cgtctagtaccacgaccggtgctcgatttagcactcgcacgttgggtttggggaggtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgttcaacagagttacagtacccccctcactttcggcggaggggaccaaggcggagatcagacggaactgtggctgcaccatctgtctnt

SEQ ID NO: 581064 - DNA, 480 bp, Homo sapiens; identical to SEQ ID NO: 547229
  misc_feature: HIJSMM301DUEWF.12.10.A10.1.454.light.4.raw

SEQ ID NO: 581065 - DNA, 502 bp, Homo sapiens; identical to SEQ ID NO: 539314
  misc_feature: HIJSMM301AWRJE.21.81.H04.1.454.light.4.raw

SEQ ID NO: 581066 - DNA, 505 bp, Homo sapiens; identical to SEQ ID NO: 535987
  misc_feature: HIJSMM301DUO6R.18.37.D04.1.454.light.4.raw

SEQ ID NO: 581067 - DNA, 518 bp, Homo sapiens; identical to SEQ ID NO: 539372
  misc_feature: HIJSMM301AEMN1.7.86.H09.1.454.light.4.raw

SEQ ID NO: 581068 - DNA, 488 bp, Homo sapiens
  misc_feature: HIJSMM301ESDDJ.48.43.D10.1.454.light.4.raw
agtatacatacacgaccggtgctcgatttagactagcagtaagggggctggtcacacttcttgcaggagtcagacccactcaggacacagcatggacatgagggtccccgctcagctcctggggcttctgctgctctggctcccaggtgccagatgtgacgtccagttgacccagtctccatcctccctgtctgcatctgtgggagacagagtcaccctcacttgccgggcaagtcaggccatttccaattctttagcctggtatcagcagaaaccaggacaaactcctacactcctgatctatgatgcgtccagtttagagagtggggccccatcgaggttcagcggcagtggatcagggacagagttcactctcaccatcagcagcctgcagcctgaagatttgcaacttattactgtcaacactttaacaattaccctcataagccgttcggccaagggacccaggtggaaaccaagcgaactgt

SEQ ID NO: 581069 - DNA, 508 bp, Homo sapiens; identical to SEQ ID NO: 540739
  misc_feature: HIJSMM301EXKVT.14.7.A07.1.454.light.4.raw

SEQ ID NO: 581070 - DNA, 491 bp, Homo sapiens
  misc_feature: HIJSMM301D289L.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacagtacccccctcactttcggcggagggaccaaggcggagatcagacgaactgtggctgcaccatctgtcttcta

SEQ ID NO: 581071 - DNA, 505 bp, Homo sapiens
  misc_feature: HIJSMM301CEBXG.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggtcggcgggacccagatgactgtcctcagtcagccaaggctgcccctcggt

SEQ ID NO: 581072 - DNA, 476 bp, Homo sapiens
  misc_feature: HIJSMM301EZ3RB.13.11.A11.1.454.light.4.raw
tcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcaccgtcctaagtcagcccc

SEQ ID NO: 581073 - DNA, 518 bp, Homo sapiens
  misc_feature: HIJSMM301C795V.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcaggggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctccgt

SEQ ID NO: 581074 - DNA, 519 bp, Homo sapiens
  misc_feature: HIJSMM301DO4WC.9.86.H09.1.454.light.4.raw
tgatacgtctcacgaccggtgctcgatttagtgctatagacttgggtttggggggggtcacaagaggcagcgctctcgggacgtctccaccatggcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagttttaaccttgtctcctggtaccaacaccacccaggcaaagccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctcgttcccgccctcctc

SEQ ID NO: 581075 - DNA, 507 bp, Homo sapiens; identical to SEQ ID NO: 561702
  misc_feature: HIJSMM301BZUS7.5.24.C02.1.454.light.4.raw

SEQ ID NO: 581076 - DNA, 517 bp, Homo sapiens; identical to SEQ ID NO: 535261
  misc_feature: HIJSMM301DUQHI.19.80.H03.1.454.light.4.raw

SEQ ID NO: 581077 - DNA, 495 bp, Homo sapiens; identical to SEQ ID NO: 535821
  misc_feature: HIJSMM301DQ88B.3.31.C09.1.454.light.4.raw

SEQ ID NO: 581078 - DNA, 518 bp, Homo sapiens; identical to SEQ ID NO: 543797
  misc_feature: HIJSMM301A2G65.19.80.H03.1.454.light.4.raw

SEQ ID NO: 581079 - DNA, 502 bp, Homo sapiens
  misc_feature: HIJSMM301BBJ29.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttggccaggggaccaagactggagatcaaacgaactgtggctgcaccta

SEQ ID NO: 581080 - DNA, 511 bp, Homo sapiens
  misc_feature: HIJSMM301BI5O6.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgttctcaacagacaccagtgacaatcatgcgattttcggcggagggaccaagctgaccgtcctgggtcagcccaaggctgccccctcggtcactctgttcccaccct

SEQ ID NO: 581081 - DNA, 512 bp, Homo sapiens
  misc_feature: HIJSMM301AS02E.43.5.A05.1.454.light.4.raw
tgtgagtagtcacgaccggtgctcgatttagatagatagacaggggtggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcgcggagggaccaagttgaccgtcctaggtcagcccaaggctgccccctcggtcactctgttcccaccctcctcacta

SEQ ID NO: 581082 - DNA, 498 bp, Homo sapiens
  misc_feature: HIJSMM301ARQ2I.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggtccaggggaccgaagctggagatcaaacgaactgtggtcg

SEQ ID NO: 581083 - DNA, 506 bp, Homo sapiens
  misc_feature: HIJSMM301CZRA1.48.34.D01.1.454.light.4.raw
agtatacatacacgaccggtgctcgatttagatcgtctgtgttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgtt

SEQ ID NO: 581084 - DNA, 498 bp, Homo sapiens; identical to SEQ ID NO: 560503
  misc_feature: HIJSMM301AG2XJ.4.27.C05.1.454.light.4.raw

SEQ ID NO: 581085 - DNA, 446 bp, Homo sapiens
  misc_feature: HIJSMM301C1ADC.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagttcctttgactattaaactggatggtggtattcggcggagggacccacgtaaccgtcctaggtcagcccaaggctcgccccctcggtcactctcgttcccaccctcctcgtatctctcg

SEQ ID NO: 581086 - DNA, 497 bp, Homo sapiens; identical to SEQ ID NO: 535286
  misc_feature: HIJSMM301DF639.18.59.F04.1.454.light.4.raw

SEQ ID NO: 581087 - DNA, 496 bp, Homo sapiens; identical to SEQ ID NO: 536690
  misc_feature: HIJSMM301AQV17.40.23.C01.1.454.light.4.raw

SEQ ID NO: 581088 - DNA, 503 bp, Homo sapiens; identical to SEQ ID NO: 538884
  misc_feature: HIJSMM301AJDOU.27.78.H01.1.454.light.4.raw

SEQ ID NO: 581089 - DNA, 497 bp, Homo sapiens
  misc_feature: HIJSMM301BVCKE.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccgaagctggaggatcaaacgaactgtggctgcaccatctgtctt

SEQ ID NO: 581090 - DNA, 463 bp, Homo sapiens; identical to SEQ ID NO: 535062
  misc_feature: HIJSMM301D8FN6.11.73.G07.1.454.light.4.raw

SEQ ID NO: 581091 - DNA, 493 bp, Homo sapiens; identical to SEQ ID NO: 548342
  misc_feature: HIJSMM301BUZEC.27.78.H01.1.454.light.4.raw

SEQ ID NO: 581092 - DNA, 463 bp, Homo sapiens; identical to SEQ ID NO: 535062
  misc_feature: HIJSMM301D9D8R.11.73.G07.1.454.light.4.raw

SEQ ID NO: 581093 - DNA, 498 bp, Homo sapiens
  misc_feature: HIJSMM301B6EZP.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacttcggccaagggaccaaggagcaaatacaaacgaactgtggctgcaccatctgtcttcatcttccccgccat

SEQ ID NO: 581094 - DNA, 495 bp, Homo sapiens; identical to SEQ ID NO: 557386
  misc_feature: HIJSMM301AHZQW.27.78.H01.1.454.light.4.raw

SEQ ID NO: 581095 - DNA, 500 bp, Homo sapiens; identical to SEQ ID NO: 546613
  misc_feature: HIJSMM301AUP8P.11.21.B10.1.454.light.4.raw

SEQ ID NO: 581096 - DNA, 503 bp, Homo sapiens
  misc_feature: HIJSMM301DRYDZ.22.9.A09.1.454.light.4.raw
  modified_base (353)..(353): a, c, t, g, unknown or other
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcggggcctaccgtctaccgtcgcagggtaccaatgagagtattagcgactacttagcctggtaccaacagaggcctggccaggctcccaggctcctcatgtatgatgcttccaaaagggccactggcatcccagccaggttcagtggcagtgggtctggaagngacttcactctcaccatcaacagccctagagcctgacgattctgcagtttattactgtcagcagcgtaccaagtggcctccgacttttggccaggggccaagctggagatcagacgaatgtggctgcaccatctgtcttcatcttccccg

SEQ ID NO: 581097 - DNA, 493 bp, Homo sapiens
  misc_feature: HIJSMM301BSUOX.48.58.F03.1.454.light.4.raw
agtatacatacacgaccggtgctcgatttagtctgatcgagaagggaaagggggagtcagacccagtcaggacacagcatggacatgagggtccccgctcagctcctggggctcctgctgctctggctcccaggtgccaaatgtgacatccagatgacccagtctccttccaccctgtctgcctctgtaggagacagggtcaccatcacttgccgggccagtcagagtattagtgactggttggcctggtatcagcagaaaccagggaaagcccctaacctcctgatctatcaggcatctactttagaaagtggggtcccatcaaggttcagcggcagtggatctgaaacagaattcactctcaccatcagcagcctgcagcctgatgattatgcgacttattactgccaacaatacactagtttgtggacgttcggccgagggaccgaaggtggaaatcaaacgaactagtggctgcaccatctgtcttcta

SEQ ID NO: 581098 - DNA, 513 bp, Homo sapiens; identical to SEQ ID NO: 545752
  misc_feature: HIJSMM301C7V9A.17.33.C11.1.454.light.4.raw

SEQ ID NO: 581099 - DNA, 446 bp, Homo sapiens
  misc_feature: HIJSMM301EGS1B.18.9.A09.1.454.light.4.raw
tacgagtatgcacgaccggtgctcgatttagcgagacgcgcagggtcctgggcccagtctgtgctgacgcagccgccctcagtgtctgggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 581100 - DNA, 483 bp, Homo sapiens; identical to SEQ ID NO: 535413
  misc_feature: HIJSMM301EA0X8.26.78.H01.1.454.light.4.raw

SEQ ID NO: 581101 - DNA, 496 bp, Homo sapiens; identical to SEQ ID NO: 540386
  misc_feature: HIJSMM301BLIX3.22.57.F02.1.454.light.4.raw

SEQ ID NO: 581102 - DNA, 512 bp, Homo sapiens
  misc_feature: HIJSMM301EZNX4.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggaggaccaagctgaccgtcttaagtcagcccaaggctgccccctcggtcactctgttcccaccctcct

SEQ ID NO: 581103 - DNA, 447 bp, Homo sapiens; identical to SEQ ID NO: 535020
  misc_feature: HIJSMM301CHC0I.18.9.A09.1.454.light.4.raw

SEQ ID NO: 581104 - DNA, 506 bp, Homo sapiens; identical to SEQ ID NO: 534969
  misc_feature: HIJSMM301D1HWI.18.37.D04.1.454.light.4.raw

SEQ ID NO: 581105 - DNA, 491 bp, Homo sapiens
  misc_feature: HIJSMM301CWV9R.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagttattactgtcagcagtatgatacctggcctccgtacacttttggccggggaccaagctggaaatcaagcgaactgtggctgcaccatctgtcttcatt

SEQ ID NO: 581106 - DNA, 485 bp, Homo sapiens; identical to SEQ ID NO: 536040
  misc_feature: HIJSMM301AYQD5.15.1.A01.1.454.light.4.raw

SEQ ID NO: 581107 - DNA, 512 bp, Homo sapiens; identical to SEQ ID NO: 562621
  misc_feature: HIJSMM301A5VMH.7.34.D01.1.454.light.4.raw

SEQ ID NO: 581108 - DNA, 495 bp, Homo sapiens
  misc_feature: HIJSMM301CM2YB.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaacgtaggacgatcaagacgaactgtggctgcaccatctgtt

SEQ ID NO: 581109 - DNA, 530 bp, Homo sapiens
  misc_feature: HIJSMM301B8JWY.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtacggaaggtacgtaaacgaacctagtaggtcgtgtcaccaactctcgtcttctactcttcccgtcccact

SEQ ID NO: 581110 - DNA, 493 bp, Homo sapiens; identical to SEQ ID NO: 537422
  misc_feature: HIJSMM301CTORW.9.34.D01.1.454.light.4.raw

SEQ ID NO: 581111 - DNA, 493 bp, Homo sapiens
  misc_feature: HIJSMM301A9RN1.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactggcctcagacttttcggtggagggaccgaaggtggagatcaaacgaactgtggctgcaccatctgtt

SEQ ID NO: 581112 - DNA, 497 bp, Homo sapiens; identical to SEQ ID NO: 554406
  misc_feature: HIJSMM301C73AE.3.33.C11.1.454.light.4.raw

SEQ ID NO: 581113 - DNA, 482 bp, Homo sapiens; identical to SEQ ID NO: 550464
  misc_feature: HIJSMM301ASVD3.13.50.E06.1.454.light.4.raw

SEQ ID NO: 581114 - DNA, 491 bp, Homo sapiens; identical to SEQ ID NO: 535194
  misc_feature: HIJSMM301BTCRE.26.78.H01.1.454.light.4.raw

SEQ ID NO: 581115 - DNA, 508 bp, Homo sapiens
  misc_feature: HIJSMM301BMNNE.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctccacttcgtcggacgggaccgaacggacggacggatacagacggaactacgtggcgtcgcaccaactcttcgttcgttccta

SEQ ID NO: 581116 - DNA, 502 bp, Homo sapiens
  misc_feature: HIJSMM301DX1H6.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcaggggtacactctggccgttctaccttttggtccgacggggaccgaaacctaggagtatacagacgaactgtggcgtgca

SEQ ID NO: 581117 - DNA, 487 bp, Homo sapiens
  misc_feature: HIJSMM301AFFXJ.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggtatcccagacaggttcagtggcagtgggtctgggacagacttcactctctccatcagcagactggagcctgaagattttgcaatttattactgtcaccagtatggtagttcacctctaactttcggcggagggaccgaaggtggagatcaaacgaactgtggctgcaccatctgtctt

SEQ ID NO: 581118 - DNA, 503 bp, Homo sapiens
  misc_feature: HIJSMM301BZE4S.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgtcccaccctcctccgtgt

SEQ ID NO: 581119 - DNA, 482 bp, Homo sapiens
  misc_feature: HIJSMM301AIW8G.52.45.E01.1.454.light.4.raw
cgcagtacgacacgaccggtgctcgatttagtgagtcagtaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggacgaaggtggagatcaaacgaactgtggctgcaccat

SEQ ID NO: 581120 - DNA, 511 bp, Homo sapiens
  misc_feature: HIJSMM301EO62A.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacgggatccccgatcgcttcatgggctccagttctggggctgaccgctacctcaccatctccaacctccagtctgacgatgaggctgagtatcactgtggagagagccacacaattgatggccaagacggttggtgttcggcggagggaccaagctgaccgtcctaggtcagcccaaggctgccccctggtcactctgttcccaccctcctcgctacgtaga

SEQ ID NO: 581121 - DNA, 491 bp, Homo sapiens; identical to SEQ ID NO: 544714
  misc_feature: HIJSMM301BC7BE.18.11.A11.1.454.light.4.raw

SEQ ID NO: 581122 - DNA, 504 bp, Homo sapiens
  misc_feature: HIJSMM301BIS3L.8.71.G05.1.454.light.4.raw
  modified_base (291)..(291): a, c, t, g, unknown or other
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctanactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttccgccat

SEQ ID NO: 581123 - DNA, 513 bp, Homo sapiens; identical to SEQ ID NO: 559106
  misc_feature: HIJSMM301CAL0Z.11.57.F02.1.454.light.4.raw

SEQ ID NO: 581124 - DNA, 483 bp, Homo sapiens; identical to SEQ ID NO: 535778
  misc_feature: HIJSMM301B0U5B.48.84.H07.1.454.light.4.raw

SEQ ID NO: 581125 - DNA, 510 bp, Homo sapiens; identical to SEQ ID NO: 553863
  misc_feature: HIJSMM301C4F3O.16.46.E02.1.454.light.4.raw

SEQ ID NO: 581126 - DNA, 486 bp, Homo sapiens; identical to SEQ ID NO: 535043
  misc_feature: HIJSMM301AVZ41.46.35.D02.1.454.light.4.raw

SEQ ID NO: 581127 - DNA, 509 bp, Homo sapiens; identical to SEQ ID NO: 539359
  misc_feature: HIJSMM301BKPCF.47.85.H08.1.454.light.4.raw

SEQ ID NO: 581128 - DNA, 491 bp, Homo sapiens; identical to SEQ ID NO: 535294
  misc_feature: HIJSMM301EGCZJ.16.68.G02.1.454.light.4.raw

SEQ ID NO: 581129 - DNA, 489 bp, Homo sapiens; identical to SEQ ID NO: 535139
  misc_feature: HIJSMM301CLW1B.14.55.E11.1.454.light.4.raw

SEQ ID NO: 581130 - DNA, 472 bp, Homo sapiens
  misc_feature: HIJSMM301E257P.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcggggggaccgaaggtggacatcaaacgaa

SEQ ID NO: 581131 - DNA, 499 bp, Homo sapiens; identical to SEQ ID NO: 562784
  misc_feature: HIJSMM301C5T5N.40.23.C01.1.454.light.4.raw

SEQ ID NO: 581132 - DNA, 490 bp, Homo sapiens
  misc_feature: HIJSMM301C4EGJ.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgttcttcggatctgggaccagggtcaccgtcctaggtcagcccaaggccaacccc

SEQ ID NO: 581133 - DNA, 489 bp, Homo sapiens; identical to SEQ ID NO: 535139
  misc_feature: HIJSMM301ESTS1.14.55.E11.1.454.light.4.raw

SEQ ID NO: 581134 - DNA, 495 bp, Homo sapiens; identical to SEQ ID NO: 535596
  misc_feature: HIJSMM301B5CPK.10.79.H02.1.454.light.4.raw

SEQ ID NO: 581135 - DNA, 478 bp, Homo sapiens; identical to SEQ ID NO: 535129
  misc_feature: HIJSMM301D7HCI.11.11.A11.1.454.light.4.raw

SEQ ID NO: 581136 - DNA, 498 bp, Homo sapiens
  misc_feature: HIJSMM301DEKR9.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctcccctcctcactctctgcacaggctctggggcctcctatgaactgacacagtcaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtcact

SEQ ID NO: 581137 - DNA, 485 bp, Homo sapiens; identical to SEQ ID NO: 535880
  misc_feature: HIJSMM301BVH8I.7.75.G09.1.454.light.4.raw

SEQ ID NO: 581138 - DNA, 516 bp, Homo sapiens
  misc_feature: HIJSMM301DRCUS.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggccacgggccgacacgtagaaatagaagacgaactacgtggcgtgcaccaactctcgtcttcacttcttccctcccc

SEQ ID NO: 581139 - DNA, 487 bp, Homo sapiens; identical to SEQ ID NO: 538190
  misc_feature: HIJSMM301CD26Y.47.70.G04.1.454.light.4.raw

SEQ ID NO: 581140 - DNA, 489 bp, Homo sapiens; identical to SEQ ID NO: 535139
  misc_feature: HIJSMM301CKJEO.14.55.E11.1.454.light.4.raw

SEQ ID NO: 581141 - DNA, 512 bp, Homo sapiens; identical to SEQ ID NO: 539813
  misc_feature: HIJSMM301BJLVP.14.7.A07.1.454.light.4.raw

SEQ ID NO: 581142 - DNA, 490 bp, Homo sapiens; identical to SEQ ID NO: 544667
  misc_feature: HIJSMM301BCZFI.12.23.C01.1.454.light.4.raw

SEQ ID NO: 581143 - DNA, 489 bp, Homo sapiens
  misc_feature: HIJSMM301CPO2W.49.42.D09.1.454.light.4.raw
agtcgagagacacgaccggtgctcgatttagacacatacgcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 581144 - DNA, 488 bp, Homo sapiens
  misc_feature: HIJSMM301C0GXL.11.25.C03.1.454.light.4.raw
  modified_base (332)..(332): a, c, t, g, unknown or other
  modified_base (353)..(353): a, c, t, g, unknown or other
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtcccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattcnctggctccaactctgggaacncagccactctgaccatcagcgggacccaggctatggatgaggctgactattattgtcaggcgtgggacagcaggcactgcccgttatgtcttcggaatgggaccaaggtcacgtcttgagtcagcccaaggccaa

SEQ ID NO: 581145 - DNA, 492 bp, Homo sapiens
  misc_feature: HIJSMM301DH5IX.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttcctgaccatctccgggctccacgctgaggacgaggctcattattactgcagctcatatacacccaaggggcactctcgtgatattcggcggagggacctggctgaccgtcctacgtcagcccaa

SEQ ID NO: 581146 - DNA, 489 bp, Homo sapiens
  misc_feature: HIJSMM301DMWT5.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataaatctgcaaacctgaggattttgcaaacttactactgtcaacagagttacaggcccccctatacttttggccaggggaccaagctggagatcacaggaactgtggctgcacc

SEQ ID NO: 581147 - DNA, 505 bp, Homo sapiens
  misc_feature: HIJSMM301BCUWA.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattacactgctgctcatatgcaggtcgtatctcttatgtcttcggaactgggaccaaggtcaccgtctaggtcagcccaaggcccaaccccactgtcta

SEQ ID NO: 581148 - DNA, 503 bp, Homo sapiens
  misc_feature: HIJSMM301DDXWO.8.28.C06.1.454.light.4.raw
  modified_base (494)..(494): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttnatcttccgc

SEQ ID NO: 581149 - DNA, 493 bp, Homo sapiens; identical to SEQ ID NO: 571339
  misc_feature: HIJSMM301B7RB7.10.72.G06.1.454.light.4.raw

SEQ ID NO: 581150 - DNA, 503 bp, Homo sapiens; identical to SEQ ID NO: 535044
  misc_feature: HIJSMM301B3CG2.19.78.H01.1.454.light.4.raw

SEQ ID NO: 581151 - DNA, 494 bp, Homo sapiens
  misc_feature: HIJSMM301EMFMN.9.86.H09.1.454.light.4.raw
tgatacgtctcacgaccggtgctcgatttagtgctatagacttgggtttgggggctttgcctgggctctgctgctcctcaccctcctcactcaggacgcagggtcctgggcccagtctgccctgactcagcctgcctccgtgtctgcgtctcctggacagtcgatcaccatctcctgcactggaaccagcattgggagtttttaaccttgtctcctggtaccaacaccacccaggcaaagcccccaaactcatgatttatgaagtcactaagcggccctcggggatttctgctcgcttctctggctccaagtccgtcaacacggcctccctgacaatctctgggctccagactgaggacgaggctcattattactgttgctcatatacaggtgtaagtagttgggtgttcggcggagggaccaagctgaccgtcctaggtcagcccaaggctgccccctcggtcactctgttcccaccctcctcagacgtatca

SEQ ID NO: 581152 - DNA, 478 bp, Homo sapiens; identical to SEQ ID NO: 535129
  misc_feature: HIJSMM301AJ6ZX.11.11.A11.1.454.light.4.raw

SEQ ID NO: 581153 - DNA, 493 bp, Homo sapiens; identical to SEQ ID NO: 535770
  misc_feature: HIJSMM301CGZZ9.51.71.G05.1.454.light.4.raw

SEQ ID NO: 581154 - DNA, 496 bp, Homo sapiens
  misc_feature: HIJSMM301CBTFK.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagtattttgctactttattactgtcagcagcgtagcaactcggcctctctactttcggcgggagggaccgagggtggagatcagacgaactgtggctgcacatctgtt

SEQ ID NO: 581155 - DNA, 497 bp, Homo sapiens; identical to SEQ ID NO: 536376
  misc_feature: HIJSMM301C3BYJ.22.9.A09.1.454.light.4.raw

SEQ ID NO: 581156 - DNA, 477 bp, Homo sapiens
  misc_feature: HIJSMM301CZ4BX.11.76.G10.1.454.light.4.raw
cgagagataccacgaccggtgctcgatttagtcactcatacaggcatacaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttgccaggggaccaggctggagatcagacgaactgtggctgca

SEQ ID NO: 581157 - DNA, 477 bp, Homo sapiens
  misc_feature: HIJSMM301CVFEE.17.29.C07.1.454.light.4.raw
cgtagactagcacgaccggtgctcgatttagagtgctacgaagggaaagggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcctagtctacg

SEQ ID NO: 581158 - DNA, 505 bp, Homo sapiens; identical to SEQ ID NO: 557473
  misc_feature: HIJSMM301DMB3E.8.19.B08.1.454.light.4.raw

SEQ ID NO: 581159 - DNA, 494 bp, Homo sapiens
  misc_feature: HIJSMM301EXW49.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatatattatacttcgtgacgtggtccaaggaccgaagtggagtatcagacgaactagtggcgtg

SEQ ID NO: 581160 - DNA, 514 bp, Homo sapiens
  misc_feature: HIJSMM301BPVMQ.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatggttttggctatttcggtgttcggcggagggacccaggtgaccgtcctacgtcagccaacggcg

SEQ ID NO: 581161 - DNA, 514 bp, Homo sapiens
  misc_feature: HIJSMM301ADLD6.10.86.H09.1.454.light.4.raw
catagtagtgcacgaccggtgctcgatttagtgctatagacttgggtttggggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggaggactaagttgaccgtcctacgtcagcccaaggctgcccctcggtcactctgttcccaccctcctccactactatg

SEQ ID NO: 581162 - DNA, 505 bp, Homo sapiens; identical to SEQ ID NO: 535503
  misc_feature: HIJSMM301CLY8L.8.28.C06.1.454.light.4.raw

SEQ ID NO: 581163 - DNA, 494 bp, Homo sapiens; identical to SEQ ID NO: 534994
  misc_feature: HIJSMM301DALDJ.27.78.H01.1.454.light.4.raw

SEQ ID NO: 581164 - DNA, 515 bp, Homo sapiens
  misc_feature: HIJSMM301CN2MY.12.85.H08.1.454.light.4.raw
atacgacgtacacgaccggtgctcgatttagtatcactcagtcgcgggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttccca

SEQ ID NO: 581165 - DNA, 501 bp, Homo sapiens; identical to SEQ ID NO: 536867
  misc_feature: HIJSMM301CFI6X.5.86.H09.1.454.light.4.raw

SEQ ID NO: 581166 - DNA, 498 bp, Homo sapiens
  misc_feature: HIJSMM301CNNCM.52.42.D09.1.454.light.4.raw
cgcagtacgacacgaccggtgctcgatttagacacatacgcagggaaaggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactcttcgg

SEQ ID NO: 581167 - DNA, 503 bp, Homo sapiens; identical to SEQ ID NO: 539069
  misc_feature: HIJSMM301BOQYP.48.26.C04.1.454.light.4.raw

SEQ ID NO: 581168 - DNA, 510 bp, Homo sapiens
  misc_feature: HIJSMM301C5MH0.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgtttcggcggagggaccaagttgaccgtcctaggtcagcccaaggctgccccctcggtcactctgtt

SEQ ID NO: 581169 - DNA, 472 bp, Homo sapiens; identical to SEQ ID NO: 536302
  misc_feature: HIJSMM301ARBV6.18.76.G10.1.454.light.4.raw

SEQ ID NO: 581170 - DNA, 502 bp, Homo sapiens
  misc_feature: HIJSMM301BSI4G.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactt

SEQ ID NO: 581171 - DNA, 503 bp, Homo sapiens; identical to SEQ ID NO: 535044
  misc_feature: HIJSMM301BKCPP.19.78.H01.1.454.light.4.raw

SEQ ID NO: 581172 - DNA, 486 bp, Homo sapiens
  misc_feature: HIJSMM301CT48J.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggtattttgctaacttattactgccagcagtataatgattaccctatcaccttcggccggggacacggctggaaactaacgaactgtgctgcaccta

SEQ ID NO: 581173 - DNA, 481 bp, Homo sapiens; identical to SEQ ID NO: 535061
  misc_feature: HIJSMM301AWBWW.16.81.H04.1.454.light.4.raw

SEQ ID NO: 581174 - DNA, 484 bp, Homo sapiens; identical to SEQ ID NO: 535441
  misc_feature: HIJSMM301D0I1Z.26.60.F05.1.454.light.4.raw

SEQ ID NO: 581175 - DNA, 502 bp, Homo sapiens; identical to SEQ ID NO: 577864
  misc_feature: HIJSMM301D8MWS.10.43.D10.1.454.light.4.raw

SEQ ID NO: 581176 - DNA, 460 bp, Homo sapiens; identical to SEQ ID NO: 536053
  misc_feature: HIJSMM301DTFEG.22.28.C06.1.454.light.4.raw

SEQ ID NO: 581177 - DNA, 506 bp, Homo sapiens
  misc_feature: HIJSMM301A60T6.27.78.H01.1.454.light.4.raw
  modified_base (435)..(435): a, c, t, g, unknown or other
agcgtcgtctcacgaccggtgctcgatttagtgtgagtagtttgggtttgggggatcttaaaagaggttctttctcgtgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatctacctgccgggcccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttntactgtcatcagagtactactttacctcaagtgatcaccttggcccaagggacacgactggagattaaacg

SEQ ID NO: 581178 - DNA, 494 bp, Homo sapiens
  misc_feature: HIJSMM301DTS0N.47.55.E11.1.454.light.4.raw
agctcacgtacacgaccggtgctcgatttagcactcgcacgttggggtttggggagagacgacccctcccctgggatcctgcagctccaggctcccgtgggtggggttagagttgggaacctatgaacattctggtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaaccccactcgtcactctgttcccaccctcctctacgtgagct

SEQ ID NO: 581179 - DNA, 510 bp, Homo sapiens; identical to SEQ ID NO: 535474
  misc_feature: HIJSMM301A3Z2M.17.33.C11.1.454.light.4.raw

SEQ ID NO: 581180 - DNA, 518 bp, Homo sapiens; identical to SEQ ID NO: 563314
  misc_feature: HIJSMM301EH5RZ.14.70.G04.1.454.light.4.raw

SEQ ID NO: 581181 - DNA, 511 bp, Homo sapiens; identical to SEQ ID NO: 548439
  misc_feature: HIJSMM301CQ0ES.16.46.E02.1.454.light.4.raw

SEQ ID NO: 581182 - DNA, 504 bp, Homo sapiens; identical to SEQ ID NO: 535495
  misc_feature: HIJSMM301CU8QZ.14.86.H09.1.454.light.4.raw

SEQ ID NO: 581183 - DNA, 495 bp, Homo sapiens; identical to SEQ ID NO: 538434
  misc_feature: HIJSMM301DJSW5.51.81.H04.1.454.light.4.raw

SEQ ID NO: 581184 - DNA, 486 bp, Homo sapiens
  misc_feature: HIJSMM301EIUIX.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcaccgacaaaaacccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtattgtgaagctccgctcactttcggcggagggaccggcgggtggaggatcagacgaactgtggctgcaccatctgtctt

SEQ ID NO: 581185 - DNA, 503 bp, Homo sapiens
  misc_feature: HIJSMM301AFC4Q.4.39.D06.1.454.light.4.raw
agcactgtagcacgaccggtgctcgatttagtgacatctcgcagttcgtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctc

SEQ ID NO: 581186 - DNA, 493 bp, Homo sapiens
  misc_feature: HIJSMM301B5DT2.15.83.H06.1.454.light.4.raw
  modified_base (488)..(488): a, c, t, g, unknown or other
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaaacttactactgtcaacagagtttcagtagtccccggacgttcgcaaggaccaaggtaggacagtcaaacgaaacagtaggctgcaccatcngtctt

SEQ ID NO: 581187 - DNA, 479 bp, Homo sapiens; identical to SEQ ID NO: 535586
  misc_feature: HIJSMM301EKXVD.13.34.D01.1.454.light.4.raw

SEQ ID NO: 581188 - DNA, 493 bp, Homo sapiens
  misc_feature: HIJSMM301BTG9I.41.16.B05.1.454.light.4.raw
tctatactatcacgaccggtgctcgatttagagctcacgtaagggggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaaacctggccaggctcccaggctcctcatctatcgtgcgtccaccagggcaactggtatcccagccaggttcagtggcgttgggtctgggacagagttcactctcaccatcaccagcctgcagtctgaagattttgcagttattactgtcaccaatataataactggtacacttttggccagggaccaagctcgagatcaaacgaactgtggctgcaccatctgtcttcatcttcccg

SEQ ID NO: 581189 - DNA, 519 bp, Homo sapiens
  misc_feature: HIJSMM301BHIZC.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtagctgcaccatctgtctcatcttccccg

SEQ ID NO: 581190 - DNA, 488 bp, Homo sapiens
  misc_feature: HIJSMM301CNU3M.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctaacaaacttcctacacttttggccaggggaccaagctggagatcaaacgaa

SEQ ID NO: 581191 - DNA, 491 bp, Homo sapiens; identical to SEQ ID NO: 535176
  misc_feature: HIJSMM301B989Z.13.39.D06.1.454.light.4.raw

SEQ ID NO: 581192 - DNA, 505 bp, Homo sapiens
  misc_feature: HIJSMM301ED0VP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaaggtggaaatcaaacgaactagtggctgcaccatctgtcttcatcttccccg

SEQ ID NO: 581193 - DNA, 489 bp, Homo sapiens; identical to SEQ ID NO: 535139
  misc_feature: HIJSMM301AGX0H.14.55.E11.1.454.light.4.raw

SEQ ID NO: 581194 - DNA, 493 bp, Homo sapiens; identical to SEQ ID NO: 579807
  misc_feature: HIJSMM301D0ZVY.10.79.H02.1.454.light.4.raw

SEQ ID NO: 581195 - DNA, 502 bp, Homo sapiens; identical to SEQ ID NO: 537816
  misc_feature: HIJSMM301CWFXX.19.78.H01.1.454.light.4.raw

SEQ ID NO: 581196 - DNA, 498 bp, Homo sapiens
  misc_feature: HIJSMM301BGBOG.14.35.D02.1.454.light.4.raw
  modified_base (407)..(407): a, c, t, g, unknown or other
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagangtggcagtttattactgtcagcaatatatagtactccctacacttttggccaggggaccaagctggagatcaaacgaactgtggctgcacc

SEQ ID NO: 581197 - DNA, 487 bp, Homo sapiens
  misc_feature: HIJSMM301CQ9RM.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccaggggtcccatctaggttccgtggaagtggatctgggacagactttactctcaccattagcagcctggagcctgaagatattgcaacatattactgtcaacagtctcatggtctcccccttagtttcggcggagggaccaaggttgagatcaaacgaactgtggctgcaccatctgtcttcat

SEQ ID NO: 581198 - DNA, 496 bp, Homo sapiens
  misc_feature: HIJSMM301D2B90.51.30.C08.1.454.light.4.raw
cgatcgtatacacgaccggtgctcgatttagtctgacgtcaaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaaacgaactgtggctgcaccta

SEQ ID NO: 581199 - DNA, 498 bp, Homo sapiens
  misc_feature: HIJSMM301CBBLW.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctctcagacgttcggccaagggaccaaggtggaaatcaaacgaactgtggctgcacca

SEQ ID NO: 581200 - DNA, 495 bp, Homo sapiens
  misc_feature: HIJSMM301D1BE0.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacagggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaaactgtggctgcaccatctgtcttcatt

SEQ ID NO: 581201 - DNA, 506 bp, Homo sapiens
  misc_feature: HIJSMM301CLSRJ.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagatttgcagtttattactgtcaacagcgtagcagcaggcctccggcgacgttcggccaagggaccaaggtggaagtcaagcgaactgtggctgcaccatctgtcttcatcttcccgcc

SEQ ID NO: 581202 - DNA, 501 bp, Homo sapiens
  misc_feature: HIJSMM301B6YNW.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtaggaaatacaaacgaactcgtggctgcacc

SEQ ID NO: 581203 - DNA, 491 bp, Homo sapiens; identical to SEQ ID NO: 535194
  misc_feature: HIJSMM301B07AM.26.78.H01.1.454.light.4.raw

SEQ ID NO: 581204 - DNA, 521 bp, Homo sapiens; identical to SEQ ID NO: 538715
  misc_feature: HIJSMM301E0HOK.27.23.C01.1.454.light.4.raw

SEQ ID NO: 581205 - DNA, 490 bp, Homo sapiens; identical to SEQ ID NO: 538273
  misc_feature: HIJSMM301AH8YX.16.73.G07.1.454.light.4.raw

SEQ ID NO: 581206 - DNA, 501 bp, Homo sapiens; identical to SEQ ID NO: 568432
  misc_feature: HIJSMM301ENSQZ.2.49.E05.1.454.light.4.raw

SEQ ID NO: 581207 - DNA, 484 bp, Homo sapiens; identical to SEQ ID NO: 535400
  misc_feature: HIJSMM301A1IVN.46.26.C04.1.454.light.4.raw

SEQ ID NO: 581208 - DNA, 504 bp, Homo sapiens
  misc_feature: HIJSMM301CTM8A.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtcaaacgaactgtggcgtgcaccatctgtcttcatcttccccg

SEQ ID NO: 581209 - DNA, 500 bp, Homo sapiens
  misc_feature: HIJSMM301DHF89.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggcccaggggaccaagctggagatcaaacgaactgtggctgcaccatctgtcttcat

SEQ ID NO: 581210 - DNA, 487 bp, Homo sapiens; identical to SEQ ID NO: 537220
  misc_feature: HIJSMM301DMA7E.16.53.E09.1.454.light.4.raw

SEQ ID NO: 581211 - DNA, 479 bp, Homo sapiens
  misc_feature: HIJSMM301DISIV.40.23.C01.1.454.light.4.raw
tctagcgactcacgaccggtgctcgatttagtacacgtgattagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaac

SEQ ID NO: 581212 - DNA, 487 bp, Homo sapiens
  misc_feature: HIJSMM301CR4R1.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgttaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaa

SEQ ID NO: 581213 - DNA, 500 bp, Homo sapiens
  misc_feature: HIJSMM301BIU9R.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactacatgatttatgatgtcactaatcggccctcaggggtttctaatcgcttctctggctccaagtctggcaacacggcctccctgaccatctctgggctccaggctgaggacgaggctgattattactgcagctcatatacaaagcaccagcaactctctatgtcttcgaactgggaccaaggtcaccgtcctaggtcagccaacgga

SEQ ID NO: 581214 - DNA, 515 bp, Homo sapiens
  misc_feature: HIJSMM301BM07C.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaatttggtcatatgttgttcggcggagggaccaagctgaccgtcctcggtcagcccaaggctgccccctggtcactctgttcccgccctcct

SEQ ID NO: 581215 - DNA, 476 bp, Homo sapiens; identical to SEQ ID NO: 538026
  misc_feature: HIJSMM301B2SYM.13.76.G10.1.454.light.4.raw

SEQ ID NO: 581216 - DNA, 509 bp, Homo sapiens; identical to SEQ ID NO: 543266
  misc_feature: HIJSMM301DLKJJ.17.33.C11.1.454.light.4.raw

SEQ ID NO: 581217 - DNA, 496 bp, Homo sapiens; identical to SEQ ID NO: 546893
  misc_feature: HIJSMM301AO6JL.51.35.D02.1.454.light.4.raw

SEQ ID NO: 581218 - DNA, 496 bp, Homo sapiens; identical to SEQ ID NO: 535541
  misc_feature: HIJSMM301EDKR2.3.33.C11.1.454.light.4.raw

SEQ ID NO: 581219 - DNA, 465 bp, Homo sapiens
  misc_feature: HIJSMM301EF9QF.18.59.F04.1.454.light.4.raw
  modified_base (436)..(437): a, c, t, g, unknown or other
  modified_base (445)..(445): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacnncacactanattcgtacgacggtcgaacg

SEQ ID NO: 581220 - DNA, 489 bp, Homo sapiens
  misc_feature: HIJSMM301B0MA9.51.71.G05.1.454.light.4.raw
cgatcgtatacacgaccggtgctcgatttagtgtcgtcgcaagagagagggggtggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcg

SEQ ID NO: 581221 - DNA, 486 bp, Homo sapiens; identical to SEQ ID NO: 545403
  misc_feature: HIJSMM301EJPJP.15.1.A01.1.454.light.4.raw

SEQ ID NO: 581222 - DNA, 447 bp, Homo sapiens; identical to SEQ ID NO: 535201
  misc_feature: HIJSMM301CO6Z1.18.9.A09.1.454.light.4.raw

SEQ ID NO: 581223 - DNA, 501 bp, Homo sapiens
  misc_feature: HIJSMM301D3SME.41.35.D02.1.454.light.4.raw
tctatactatcacgaccggtgctcgattagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtctaggtcagcccaaggctgccccctcggt

SEQ ID NO: 581224 - DNA, 486 bp, Homo sapiens
  misc_feature: HIJSMM301DLIFJ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaaggtggatatcagacgaa

SEQ ID NO: 581225 - DNA, 500 bp, Homo sapiens
  misc_feature: HIJSMM301DSHT5.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcacttttcaccatcagcagcctgcaggctgaagatgtggcagtttattactgtcagcaatattatagtactccctacacttttggccaggggaccaagctggagatcaaacgaactgtggctgcacc

SEQ ID NO: 581226 - DNA, 483 bp, Homo sapiens
  misc_feature: HIJSMM301A5LUU.51.24.C02.1.454.light.4.raw
cgatcgtatacacgaccggtgctcgatttagtacagatcgttagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaactcctgatctatgctgcatccagtttgcaaagtgaggtcccatccaggttcagtggcagtggatctgggacagatttcactctcaccatcagtagtctgcaacctgaagattttgcaacttactactgtcaacagagttacggtacctgctcactttcggcggagggaccaaggtggagatcaaacgaactgtggctgcaccta

SEQ ID NO: 581227 - DNA, 505 bp, Homo sapiens; identical to SEQ ID NO: 535503
  misc_feature: HIJSMM301BTVV4.8.28.C06.1.454.light.4.raw

SEQ ID NO: 581228 - DNA, 496 bp, Homo sapiens
  misc_feature: HIJSMM301DLENU.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccc

SEQ ID NO: 581229 - DNA, 498 bp, Homo sapiens
  misc_feature: HIJSMM301CGH1A.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccacccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 581230 - DNA, 496 bp, Homo sapiens; identical to SEQ ID NO: 559735
  misc_feature: HIJSMM301CEYAY.13.38.D05.1.454.light.4.raw

SEQ ID NO: 581231 - DNA, 493 bp, Homo sapiens
  misc_feature: HIJSMM301AOZUE.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactagtggctgcaccatctgtt

SEQ ID NO: 581232 - DNA, 485 bp, Homo sapiens; identical to SEQ ID NO: 535606
  misc_feature: HIJSMM301AGTZL.47.46.E02.1.454.light.4.raw

SEQ ID NO: 581233 - DNA, 521 bp, Homo sapiens
  misc_feature: HIJSMM301DW7H3.12.71.G05.1.454.light.4.raw
atacgacgtacacgaccggtgctcgatttagtgtcgtcgcaagagagaggggggggtcgacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccct

SEQ ID NO: 581234 - DNA, 513 bp, Homo sapiens; identical to SEQ ID NO: 541387
  misc_feature: HIJSMM301BUEYM.17.33.C11.1.454.light.4.raw

SEQ ID NO: 581235 - DNA, 466 bp, Homo sapiens
  misc_feature: HIJSMM301C6S1C.52.2.A02.1.454.light.4.raw
cgcagtacgacacgaccggtgctcgatttagactcatctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattaacatgtatctgaattggtatcagcagaaaccagggaaagcccctaaactcctgatcctcgatgcatccaatttggaaacaggggtcccatcaaggttcagtggaagtggctctgggacagattttactttcaccatcgccagactgcagcctgaagatattgcaacatattactgtcaacagtatgataatctcccgctcactttcggcggagggaccaaggtggagatcagacgaa

SEQ ID NO: 581236 - DNA, 494 bp, Homo sapiens; identical to SEQ ID NO: 534992
  misc_feature: HIJSMM301DK3U1.9.1.A01.1.454.light.4.raw

SEQ ID NO: 581237 - DNA, 493 bp, Homo sapiens; identical to SEQ ID NO: 550309
  misc_feature: HIJSMM301CLPFY.9.1.A01.1.454.light.4.raw

SEQ ID NO: 581238 - DNA, 480 bp, Homo sapiens
  misc_feature: HIJSMM301AKIE6.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcacc

SEQ ID NO: 581239 - DNA, 486 bp, Homo sapiens; identical to SEQ ID NO: 535043
  misc_feature: HIJSMM301CNF6J.46.35.D02.1.454.light.4.raw

SEQ ID NO: 581240 - DNA, 507 bp, Homo sapiens
  misc_feature: HIJSMM301EJQD3.15.86.H09.1.454.light.4.raw
tctacgtagccacgaccggtgctcgatttagtgctatagacttgggtttggggtccactgggcagtctcgaatagagctcttggaagtccctccaaccatggcctgggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaagttaagagtgatggcagccacaccaagggggacggggatcccgactcgcttcatgggctccagttctgggcgtgaccgctacctcaccatctccaacctccagtctgacgatgaggctgagtatcactgtggagagagccacacaattgatggccaagacggttgggtgttcggcggagggaccaagctgaccgtcctaggtcacg

SEQ ID NO: 581241 - DNA, 505 bp, Homo sapiens; identical to SEQ ID NO: 539634
  misc_feature: HIJSMM301CIK97.48.78.H01.1.454.light.4.raw

SEQ ID NO: 581242 - DNA, 515 bp, Homo sapiens
  misc_feature: HIJSMM301A0UR3.52.57.F02.1.454.light.4.raw
cgcagtacgacacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcgacaacaatttgggggttttcggcggagggaccaaggtgaccgtcctacgtcagcccaaggctgccccctcggtcactt

SEQ ID NO: 581243 - DNA, 520 bp, Homo sapiens
  misc_feature: HIJSMM301DFD61.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaacccactgtcactctgttcccgccctcct

SEQ ID NO: 581244 - DNA, 482 bp, Homo sapiens; identical to SEQ ID NO: 544665
  misc_feature: HIJSMM301B18DG.8.14.B03.1.454.light.4.raw

SEQ ID NO: 581245 - DNA, 520 bp, Homo sapiens
  misc_feature: HIJSMM301A31XW.9.38.D05.1.454.light.4.raw
tgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgcccctcggtcactctgttcccgcctcctcacg

SEQ ID NO: 581246 - DNA, 491 bp, Homo sapiens; identical to SEQ ID NO: 535294
  misc_feature: HIJSMM301A3G25.16.68.G02.1.454.light.4.raw

SEQ ID NO: 581247 - DNA, 509 bp, Homo sapiens; identical to SEQ ID NO: 539269
  misc_feature: HIJSMM301CKKW2.4.57.F02.1.454.light.4.raw

SEQ ID NO: 581248 - DNA, 507 bp, Homo sapiens
  misc_feature: HIJSMM301BFYVS.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgacgtcctaggtcagcccaaggctgccccctcggtctac

SEQ ID NO: 581249 - DNA, 515 bp, Homo sapiens
  misc_feature: HIJSMM301CB7QT.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaaggtaggaaagtactaaacgaactagtggctggcaccactctgttcttctatcttccccg

SEQ ID NO: 581250 - DNA, 373 bp, Homo sapiens; identical to SEQ ID NO: 539301
  misc_feature: HIJSMM301AG57O.21.25.C03.1.454.light.4.raw

SEQ ID NO: 581251 - DNA, 515 bp, Homo sapiens
  misc_feature: HIJSMM301CEKPC.12.53.E09.1.454.light.4.raw
atacgacgtacacgaccggtgctcgatttagagagagtgtgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcacgcccaaggctcgccccctcggtcta

SEQ ID NO: 581252 - DNA, 495 bp, Homo sapiens; identical to SEQ ID NO: 538269
  misc_feature: HIJSMM301BNF1T.9.1.A01.1.454.light.4.raw

SEQ ID NO: 581253 - DNA, 496 bp, Homo sapiens; identical to SEQ ID NO: 535109
  misc_feature: HIJSMM301B1QSK.16.78.H01.1.454.light.4.raw

SEQ ID NO: 581254 - DNA, 490 bp, Homo sapiens; identical to SEQ ID NO: 565304
  misc_feature: HIJSMM301CFRUX.21.65.F10.1.454.light.4.raw

SEQ ID NO: 581255 - DNA, 505 bp, Homo sapiens; identical to SEQ ID NO: 535503
  misc_feature: HIJSMM301BEB1Q.8.28.C06.1.454.light.4.raw

SEQ ID NO: 581256 - DNA, 475 bp, Homo sapiens
  misc_feature: HIJSMM301ARI92.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccgtcagcagcctgcagtctgaagattttgcaacttattactgtctacaagattataattaccctcggacgttcgccagggaccgacgtggtggtagtgtgacgacgaacgtgt

SEQ ID NO: 581257 - DNA, 479 bp, Homo sapiens; identical to SEQ ID NO: 540873
  misc_feature: HIJSMM301AK40Q.40.59.F04.1.454.light.4.raw

SEQ ID NO: 581258 - DNA, 497 bp, Homo sapiens; identical to SEQ ID NO: 535286
  misc_feature: HIJSMM301DZG4W.18.59.F04.1.454.light.4.raw

SEQ ID NO: 581259 - DNA, 488 bp, Homo sapiens; identical to SEQ ID NO: 537673
  misc_feature: HIJSMM301AE4W7.12.31.C09.1.454.light.4.raw

SEQ ID NO: 581260 - DNA, 481 bp, Homo sapiens; identical to SEQ ID NO: 545581
  misc_feature: HIJSMM301EM3VV.48.19.B08.1.454.light.4.raw

SEQ ID NO: 581261 - DNA, 489 bp, Homo sapiens
  misc_feature: HIJSMM301CGUY8.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtccagggaccgaagctggaggatcaaacgaaactgtggctgcaccat

SEQ ID NO: 581262 - DNA, 506 bp, Homo sapiens; identical to SEQ ID NO: 540748
  misc_feature: HIJSMM301AFDPM.18.37.D04.1.454.light.4.raw

SEQ ID NO: 581263 - DNA, 504 bp, Homo sapiens
  misc_feature: HIJSMM301D9AXD.19.75.G09.1.454.light.4.raw
tactctcgtgcacgaccggtgctcgatttagtatagacatcaggggtccaaacagaccttcagcaagcatagtgggaatctgcaccatgccctgggctctgatcctcctgaccctcctcactcactctgcagtgtcagtggtccaggcagggctgactcagccaccctcggtgtccgagggcttgggacgaaccgccactctcacctgcactgggaacagcaacaatgttggcaaccaaggggcagcttggctgcagcagcaccggggccaccctcccaagctcctgtcctacaggaataccaaccggccctcagggatctcagagagattctctgcatccaggtcaggaaacacagcctccctgaccatttctggactccagcctgacgacgaggctgactattactgttcagcgtgggacagcagcctcgctgcgttgggtgttcgggcggagggaccaagctcgaccctccgtgggtcacgcccgaaggctcgtccccccg

SEQ ID NO: 581264 - DNA, 503 bp, Homo sapiens; identical to SEQ ID NO: 555460
  misc_feature: HIJSMM301E4G04.8.42.D09.1.454.light.4.raw

SEQ ID NO: 581265 - DNA, 489 bp, Homo sapiens; identical to SEQ ID NO: 535139
  misc_feature: HIJSMM301EOLTZ.14.55.E11.1.454.light.4.raw

SEQ ID NO: 581266 - DNA, 485 bp, Homo sapiens
  misc_feature: HIJSMM301CY6UC.52.34.D01.1.454.light.4.raw
cgcagtacgacacgaccggtgctcgatttagatcgtctgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcagtttgggtgttcggcggagggaccaagttgaccgtctaggtcagcccaaggctcg

SEQ ID NO: 581267 - DNA, 484 bp, Homo sapiens; identical to SEQ ID NO: 541607
  misc_feature: HIJSMM301DPOPE.17.26.C04.1.454.light.4.raw

SEQ ID NO: 581268 - DNA, 497 bp, Homo sapiens
  misc_feature: HIJSMM301BDZK0.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttccaccctcaccatcaatagcctggaagctgaagatgctgcaacttattactgtcatcagagtacttacttacctcaagtgatcaccttcggccaagggacacgactggagaattaaacgaactgtggctgcaccatctgtctt

SEQ ID NO: 581269 - DNA, 504 bp, Homo sapiens
  misc_feature: HIJSMM301BJV7K.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgcccctcggtcactctgtt

SEQ ID NO: 581270 - DNA, 482 bp, Homo sapiens
  misc_feature: HIJSMM301CVZDG.4.11.A11.1.454.light.4.raw
agcactgtagcacgaccggtgctcgatttagctacgactgcagggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcactatcacctgtcgggccagtcagaatattaatagttggttggcctggtatcaccagagaccaggagaagccccaaagctcatcatttatgatgcctccactttgaatggtggggtcccaccaacgttcagtggcagtggatctgggacagagttcactctcaccatcagcagcctgcagcctgatgatcttggaacttattactgaccaacaataataataattattggacgttcggccgagggaccaaggtacgaaatgagacgaactgtggctgcaccatctgtt

SEQ ID NO: 581271 - DNA, 499 bp, Homo sapiens
  misc_feature: HIJSMM301DVCXO.48.35.D02.1.454.light.4.raw
agtatacatacacgaccggtgctcgatttagcacacgatagttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtctaggtcagcccaaggctcgccccc

SEQ ID NO: 581272 - DNA, 489 bp, Homo sapiens; identical to SEQ ID NO: 541702
  misc_feature: HIJSMM301AGJMT.10.72.G06.1.454.light.4.raw

SEQ ID NO: 581273 - DNA, 479 bp, Homo sapiens; identical to SEQ ID NO: 553368
  misc_feature: HIJSMM301D5X2N.7.76.G10.1.454.light.4.raw

SEQ ID NO: 581274 - DNA, 520 bp, Homo sapiens
  misc_feature: HIJSMM301EWSBD.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgcctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgtgcaatctgggatgacagtgtgaacggtccggtttcggcggagggaccaagctgaccgtcctaagtcagcccaaggctgccccctggtccactctgttccccacctcctccacg

SEQ ID NO: 581275 - DNA, 491 bp, Homo sapiens; identical to SEQ ID NO: 535176
  misc_feature: HIJSMM301BFETP.13.39.D06.1.454.light.4.raw

SEQ ID NO: 581276 - DNA, 503 bp, Homo sapiens; identical to SEQ ID NO: 537189
  misc_feature: HIJSMM301AUTF5.19.85.H08.1.454.light.4.raw

SEQ ID NO: 581277 - DNA, 487 bp, Homo sapiens; identical to SEQ ID NO: 537220
  misc_feature: HIJSMM301BLP4Q.16.53.E09.1.454.light.4.raw

SEQ ID NO: 581278 - DNA, 499 bp, Homo sapiens; identical to SEQ ID NO: 551769
  misc_feature: HIJSMM301COXZM.43.34.D01.1.454.light.4.raw

SEQ ID NO: 581279 - DNA, 493 bp, Homo sapiens
  misc_feature: HIJSMM301D90U6.9.75.G09.1.454.light.4.raw
tgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtggggtcccatcaagattcagcggcagtggatctgggacagaattcactctcaccatcagcagtctgcagcctgatgattttgcaacttattactgccaacagtataatagttatccgtggacatttggccaagggaccgaggtggaagtcaaacgaactgtggctgcaccatctgtcttcatcttccccg

SEQ ID NO: 581280 - DNA, 499 bp, Homo sapiens; identical to SEQ ID NO: 542528
  misc_feature: HIJSMM301DREYF.52.34.D01.1.454.light.4.raw

SEQ ID NO: 581281 - DNA, 383 bp, Homo sapiens; identical to SEQ ID NO: 447524
  misc_feature: HIJSMM301DGMEL.41.26.C04.1.454.light.4.raw

SEQ ID NO: 581282 - DNA, 441 bp, Homo sapiens
  misc_feature: HIJSMM301B5VWJ.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcctaccctcctcgtatctctcg

SEQ ID NO: 581283 - DNA, 473 bp, Homo sapiens
  misc_feature: HIJSMM301A2PN8.49.37.D04.1.454.light.4.raw
agtcgagagacacgaccggtgctcgatttagtagcatactgttgggtttgggggagtcagtctcagtcaggacacagcatggacatgagggtcccgctcagctcctggggctcctgctactctggctccgaggtgccagatgtgacatcctgatgacccagtctccatcctccctgtctgcatctgtaggagacagagtcaccatcacttgccgggcaagtcagagcatcacctactatttaaattggtaatcagcaaaacccagggaaagcccctaagctcctgatctatgctgcatccaatctgcaaagtgggtccatcaaggttcagtggcagtggatctgggacagatttcaccctcaccatcagcagtctgcaacctgatgattttgcaacttattattgtcaacagagttacagtatcccgtacactttggccaggggaccaggctggatatcagacgaactcgtgg

SEQ ID NO: 581284 - DNA, 507 bp, Homo sapiens
  misc_feature: HIJSMM301AK667.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgtaatcgcttctctggctccaagtctggcgacacggcctccctcgaccactctctgggcgtccaggctgaagacgaggctgattattactgcagctcatatacaggcagcagcactcaggttttcggtcggagggaccgaagctgaccgtcctacggtcagcccaaggctgccccctccggtcc

SEQ ID NO: 581285 - DNA, 492 bp, Homo sapiens; identical to SEQ ID NO: 536087
  misc_feature: HIJSMM301DVEPJ.10.17.B06.1.454.light.4.raw

SEQ ID NO: 581286 - DNA, 503 bp, Homo sapiens; identical to SEQ ID NO: 543938
  misc_feature: HIJSMM301COF50.4.71.G05.1.454.light.4.raw

SEQ ID NO: 581287 - DNA, 493 bp, Homo sapiens
  misc_feature: HIJSMM301CJXSN.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccccgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtcttgagtcagcccaaggccaacccca

SEQ ID NO: 581288 - DNA, 508 bp, Homo sapiens; identical to SEQ ID NO: 552440
  misc_feature: HIJSMM301B3ZTE.5.24.C02.1.454.light.4.raw

SEQ ID NO: 581289 - DNA, 494 bp, Homo sapiens; identical to SEQ ID NO: 534994
  misc_feature: HIJSMM301D5J6G.27.78.H01.1.454.light.4.raw

SEQ ID NO: 581290 - DNA, 495 bp, Homo sapiens; identical to SEQ ID NO: 555261
  misc_feature: HIJSMM301B2CMX.51.71.G05.1.454.light.4.raw

SEQ ID NO: 581291 - DNA, 486 bp, Homo sapiens
  misc_feature: HIJSMM301BLQTH.4.33.C11.1.454.light.4.raw
agcactgtagcacgaccggtgctcgatttagagtgagctcgttgggtttgggggagtcagactcagtcaggacacagcatggacatgtgggtccccgctcagctcctggggctcctgctgctctggctcccaggtgccaaatgtgacatccagatgacccagtctccctccaccctgtctgcattctttaggagacagagtcaccatcacctgccgggccagtcaaagtattagtaactcgttggcctggtatcagcaaagaccaggcagagccccaaagctccttatctctgatcgcctccaatttgcacagtggggtcccaccaacgttcagcggcagtggatctgggacagagttcactctcaccatcagcagcctgcagcctgacgatgtggcaacttattaactgccaacagtatgattagttattggacgttcggccgaaggaccaagatagaaatacaaacgaactgtggctgcaccta

SEQ ID NO: 581292 - DNA, 489 bp, Homo sapiens
  misc_feature: HIJSMM301DE153.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagactttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 581293 - DNA, 484 bp, Homo sapiens
  misc_feature: HIJSMM301BX5KG.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggctccgtacatgtacacttttggccaggggaccaacctggagat

SEQ ID NO: 581294 - DNA, 489 bp, Homo sapiens; identical to SEQ ID NO: 544819
  misc_feature: HIJSMM301AR6IN.11.28.C06.1.454.light.4.raw

SEQ ID NO: 581295 - DNA, 484 bp, Homo sapiens
  misc_feature: HIJSMM301DT55I.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcacagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 581296 - DNA, 507 bp, Homo sapiens
  misc_feature: HIJSMM301EW4BA.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacaacgactggagaagttaaacgtaaacgtacgttggcgtgcaccactctcgtt

SEQ ID NO: 581297 - DNA, 493 bp, Homo sapiens
  misc_feature: HIJSMM301BDMD3.3.78.H01.1.454.light.4.raw
agacgcactccacgaccggtgctcgatttagtgtgagtagtttgggtttggggaggaactgctcagttaggacccagagggaaccatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttc

SEQ ID NO: 581298 - DNA, 504 bp, Homo sapiens
  misc_feature: HIJSMM301DLJSZ.52.34.D01.1.454.light.4.raw
cgcagtacgacacgaccggtgctcgatttagatcgtctgtgttgggtttgggggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatcttccccg

SEQ ID NO: 581299 - DNA, 514 bp, Homo sapiens
  misc_feature: HIJSMM301AWCAM.43.23.C01.1.454.light.4.raw
tgtgagtagtcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgtt

SEQ ID NO: 581300 - DNA, 489 bp, Homo sapiens; identical to SEQ ID NO: 542098
  misc_feature: HIJSMM301ALXI0.13.10.A10.1.454.light.4.raw

SEQ ID NO: 581301 - DNA, 498 bp, Homo sapiens
  misc_feature: HIJSMM301CDTN6.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaaacgaactgtggctgcaccatctgtt

SEQ ID NO: 581302 - DNA, 477 bp, Homo sapiens
  misc_feature: HIJSMM301C615Q.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaagggaccaaggtggaaatacaacgaactgtggctgca

SEQ ID NO: 581303 - DNA, 503 bp, Homo sapiens; identical to SEQ ID NO: 564520
  misc_feature: HIJSMM301E4EKX.41.19.B08.1.454.light.4.raw

SEQ ID NO: 581304 - DNA, 441 bp, Homo sapiens
  misc_feature: HIJSMM301C9WN3.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaagtcagcccaaggctgccccctcggtcactctgttcccaccctcctcgtatctctcg

SEQ ID NO: 581305 - DNA, 494 bp, Homo sapiens; identical to SEQ ID NO: 534992
  misc_feature: HIJSMM301EQGMT.9.1.A01.1.454.light.4.raw

SEQ ID NO: 581306 - DNA, 492 bp, Homo sapiens
  misc_feature: HIJSMM301BXKH0.49.52.E08.1.454.light.4.raw
agtcgagagacacgaccggtgctcgatttagtcgagctctcagagagaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgt

SEQ ID NO: 581307 - DNA, 495 bp, Homo sapiens; identical to SEQ ID NO: 536359
  misc_feature: HIJSMM301BDE1X.48.4.A04.1.454.light.4.raw

SEQ ID NO: 581308 - DNA, 488 bp, Homo sapiens; identical to SEQ ID NO: 556216
  misc_feature: HIJSMM301DI65D.14.55.E11.1.454.light.4.raw

SEQ ID NO: 581309 - DNA, 486 bp, Homo sapiens
  misc_feature: HIJSMM301BQUPP.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaacttcctacacttttggcaggggaccaagctggagatacaaacgaa

SEQ ID NO: 581310 - DNA, 507 bp, Homo sapiens
  misc_feature: HIJSMM301DCSWZ.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctggtcactctgttcccgccctcc

SEQ ID NO: 581311 - DNA, 500 bp, Homo sapiens
  misc_feature: HIJSMM301CD26F.49.60.F05.1.454.light.4.raw
agtcgagagacacgaccggtgctcgatttagtacgtcatcagggaaaggggatgagcaaaactgacaagtcaaggcaggaagatgtcgccatcacaactcattgggtttctgctgctctgggttccagcctcctggggtgaagttgtgctgactcagtctccagactttcactctgtgaccccaaaggagaaagtcaccatcacctgccgggccagtcagaacattggtaataacttacactggtaccagcagaaaccagatcagtctccaaagctcctcatcaaatttgctacccagtccttctcaggggtcccctcgaggttcagtggcagtggatctgggacagacttcaccctcaccatcagtagcctggaacctgaagatgctgcagcgtattactgtcatcagactattactttaccggagactttcggccaagggaccaaggtggaaatcaaacgaactgtggctgcaccatctgtcttcatcttcccgccat

SEQ ID NO: 581312 - DNA, 490 bp, Homo sapiens; identical to SEQ ID NO: 538273
  misc_feature: HIJSMM301DG1YW.16.73.G07.1.454.light.4.raw

SEQ ID NO: 581313 - DNA, 530 bp, Homo sapiens
  misc_feature: HIJSMM301BKP4O.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctatttcggtcggagggaccgaagactgaccgtccctgggtcagcccaacggcgtgccccctccggtccgacctccttgtttccccggcccctcccttccttaccgtcggttact

SEQ ID NO: 581314 - DNA, 497 bp, Homo sapiens; identical to SEQ ID NO: 535664
  misc_feature: HIJSMM301CN40A.22.14.B03.1.454.light.4.raw

SEQ ID NO: 581315 - DNA, 500 bp, Homo sapiens
  misc_feature: HIJSMM301CCC7M.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggtcggagggaccgaacggtaggtaggatactaaacgaaacctta

SEQ ID NO: 581316 - DNA, 492 bp, Homo sapiens
  misc_feature: HIJSMM301A7ZQ0.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatacaaacgaactgtggctgcaccatctgtcttc

SEQ ID NO: 581317 - DNA, 524 bp, Homo sapiens
  misc_feature: HIJSMM301ANIVG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcgggagggaccaggctgaccgtcctaggtcacgcccaaggctgccccctcggtcactctgtccctaccct

SEQ ID NO: 581318 - DNA, 492 bp, Homo sapiens
  misc_feature: HIJSMM301DEZB5.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacacgtacccccctcactttcggcggagggaccaagggcggagatcagacgaactgtggctgcaccatctgtcttcta

SEQ ID NO: 581319 - DNA, 486 bp, Homo sapiens; identical to SEQ ID NO: 544134
  misc_feature: HIJSMM301BUZOS.17.26.C04.1.454.light.4.raw

SEQ ID NO: 581320 - DNA, 494 bp, Homo sapiens
  misc_feature: HIJSMM301BBU2Q.27.78.H01.1.454.light.4.raw
  modified_base (379)..(379): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggacacgactggagattaaacgaactgtggctgcaccatctgtctt

SEQ ID NO: 581321 - DNA, 486 bp, Homo sapiens; identical to SEQ ID NO: 550554
  misc_feature: HIJSMM301D9J4N.3.55.E11.1.454.light.4.raw

SEQ ID NO: 581322 - DNA, 495 bp, Homo sapiens; identical to SEQ ID NO: 535486
  misc_feature: HIJSMM301DHOV6.26.72.G06.1.454.light.4.raw

SEQ ID NO: 581323 - DNA, 486 bp, Homo sapiens; identical to SEQ ID NO: 554021
  misc_feature: HIJSMM301CHDNJ.40.83.H06.1.454.light.4.raw

SEQ ID NO: 581324 - DNA, 503 bp, Homo sapiens
  misc_feature: HIJSMM301C4XUY.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtgggtcccatcaaggttcagtgcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgccat

SEQ ID NO: 581325 - DNA, 501 bp, Homo sapiens
  misc_feature: HIJSMM301A468I.3.4.A04.1.454.light.4.raw
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcgccacggaccaaggtggaaatcaaacgaactgtggcgtgcaccatctgtcttcta

SEQ ID NO: 581326 - DNA, 494 bp, Homo sapiens; identical to SEQ ID NO: 534994
  misc_feature: HIJSMM301EWAEE.27.78.H01.1.454.light.4.raw

SEQ ID NO: 581327 - DNA, 496 bp, Homo sapiens
  misc_feature: HIJSMM301AR8C4.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggccgagctgaccgtcctacgtcagcccaaggctcg

SEQ ID NO: 581328 - DNA, 495 bp, Homo sapiens
  misc_feature: HIJSMM301CND0S.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgagggaccgaccggtggagtgtctaagacgaactcgtggcgtgcaccatcttcg

SEQ ID NO: 581329 - DNA, 504 bp, Homo sapiens; identical to SEQ ID NO: 538940
  misc_feature: HIJSMM301BBAJT.2.35.D02.1.454.light.4.raw

SEQ ID NO: 581330 - DNA, 482 bp, Homo sapiens; identical to SEQ ID NO: 552791
  misc_feature: HIJSMM301C0ZDN.11.76.G10.1.454.light.4.raw

SEQ ID NO: 581331 - DNA, 514 bp, Homo sapiens; identical to SEQ ID NO: 543870
  misc_feature: HIJSMM301CX0R2.40.12.B01.1.454.light.4.raw

SEQ ID NO: 581332 - DNA, 502 bp, Homo sapiens
  misc_feature: HIJSMM301DPSXE.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattggccgatcaccttcggccaagggacacgactggagattaaacgaactgtggctgcaccatctgtcttcatcttcccgccat

SEQ ID NO: 581333 - DNA, 480 bp, Homo sapiens
  misc_feature: HIJSMM301DQ7O2.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtggcttttcggcggagggaccaagctgaccgtcctaagtcagccaaggctgcccctc

SEQ ID NO: 581334 - DNA, 524 bp, Homo sapiens
  misc_feature: HIJSMM301AS862.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgcccccgtcggtcactctcgttcccaccct

SEQ ID NO: 581335 - DNA, 506 bp, Homo sapiens; identical to SEQ ID NO: 539926
  misc_feature: HIJSMM301DRS96.5.24.C02.1.454.light.4.raw

SEQ ID NO: 581336 - DNA, 481 bp, Homo sapiens
  misc_feature: HIJSMM301CYUFL.48.86.H09.1.454.light.4.raw
agtatacatacacgaccggtgctcgatttagtgctatagacttgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccaaggcc

SEQ ID NO: 581337 - DNA, 479 bp, Homo sapiens; identical to SEQ ID NO: 535586
  misc_feature: HIJSMM301DICC6.13.34.D01.1.454.light.4.raw

SEQ ID NO: 581338 - DNA, 499 bp, Homo sapiens; identical to SEQ ID NO: 575204
  misc_feature: HIJSMM301B2BSC.5.24.C02.1.454.light.4.raw

SEQ ID NO: 581339 - DNA, 509 bp, Homo sapiens; identical to SEQ ID NO: 564382
  misc_feature: HIJSMM301D4LT4.11.57.F02.1.454.light.4.raw

SEQ ID NO: 581340 - DNA, 485 bp, Homo sapiens; identical to SEQ ID NO: 542735
  misc_feature: HIJSMM301CMO33.26.45.E01.1.454.light.4.raw

SEQ ID NO: 581341 - DNA, 496 bp, Homo sapiens; identical to SEQ ID NO: 537925
  misc_feature: HIJSMM301AT870.22.14.B03.1.454.light.4.raw

SEQ ID NO: 581342 - DNA, 507 bp, Homo sapiens
  misc_feature: HIJSMM301B74C7.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctggtgttcggcggagggaccaaactgaccgtcctaggtcagcccaaggctgccccctcggtcactctgttccccg

SEQ ID NO: 581343 - DNA, 488 bp, Homo sapiens; identical to SEQ ID NO: 537504
  misc_feature: HIJSMM301BIKVC.17.57.F02.1.454.light.4.raw

SEQ ID NO: 581344 - DNA, 515 bp, Homo sapiens
  misc_feature: HIJSMM301CAENX.9.43.D10.1.454.light.4.raw
tgatacgtctcacgaccggtgctcgatttagactagcagtaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcattggtggttatgactatgtctcctggtatcaacaacacccaggcaaagcccccaaactcttgatttatgaggtcagtaggaggccctcaggggtccctgatcgcttctctggctccaagtctgccaacacggcctccctgaccgtctctgggctccaggctgaggatgaggctgattattattgcagctcatattcaggcagtaacagggttttcggcggagggaccaagctgaccgtcctaggtcagcccaaggctgccccctcggtcactttgttcccaccctcctcagtacg

SEQ ID NO: 581345 - DNA, 492 bp, Homo sapiens; identical to SEQ ID NO: 535126
  misc_feature: HIJSMM301D2ITR.18.11.A11.1.454.light.4.raw

SEQ ID NO: 581346 - DNA, 484 bp, Homo sapiens; identical to SEQ ID NO: 535400
  misc_feature: HIJSMM301EPEP1.46.26.C04.1.454.light.4.raw

SEQ ID NO: 581347 - DNA, 475 bp, Homo sapiens
  misc_feature: HIJSMM301AT84Y.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctccactttcggcggagggaccaaggtggagatcaaacgaactgtggctgcacatctgtt

SEQ ID NO: 581348 - DNA, 509 bp, Homo sapiens
  misc_feature: HIJSMM301EYTUJ.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcgaccagggaccgacgacgtagaaagtagagacgaacgtagtggctgcaccatctgtcttctatcttcccgt

SEQ ID NO: 581349 - DNA, 487 bp, Homo sapiens; identical to SEQ ID NO: 535583
  misc_feature: HIJSMM301DVU9L.22.73.G07.1.454.light.4.raw

SEQ ID NO: 581350 - DNA, 505 bp, Homo sapiens
  misc_feature: HIJSMM301EY44K.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtctacgtcagcccaaggctgccccctcggtcactc

SEQ ID NO: 581351 - DNA, 502 bp, Homo sapiens
  misc_feature: HIJSMM301D585P.9.28.C06.1.454.light.4.raw
tgatacgtctcacgaccggtgctcgatttagagctcacgtattgggtttggggggaagcctgagaacacttagccttcatgagtgtccccaccatggcctggaggatgcttctcctcggactccttgcttatggatcaggagtggattctcagactgtggtgacccaggagccatcgttctcagtgtcccctggagggacagtcacactcacttgtggcttgagctctggctcagtctctacttttactaccccacctggtaccagcagaccccaggccaggctccacgtatgatcatctacagcacaaacactcgctcttctggggtccctgatcgcttctctggctccatccttgggaacaaagctgccctcaccatcacgggggcccaggcagatgatgaatctgattattactgtgttctatatatggatcgtggcatttggatgttcggcggagggaccaagttgaccgtcctaggtcagcccaaggctgccccccg

SEQ ID NO: 581352 - DNA, 505 bp, Homo sapiens; identical to SEQ ID NO: 535503
  misc_feature: HIJSMM301AHL60.8.28.C06.1.454.light.4.raw

SEQ ID NO: 581353 - DNA, 503 bp, Homo sapiens; identical to SEQ ID NO: 542253
  misc_feature: HIJSMM301DIDLS.12.53.E09.1.454.light.4.raw

SEQ ID NO: 581354 - DNA, 508 bp, Homo sapiens; identical to SEQ ID NO: 560800
  misc_feature: HIJSMM301EI278.17.33.C11.1.454.light.4.raw

SEQ ID NO: 581355 - DNA, 494 bp, Homo sapiens
  misc_feature: HIJSMM301CQS40.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccagactcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatct

SEQ ID NO: 581356 - DNA, 484 bp, Homo sapiens; identical to SEQ ID NO: 569020
  misc_feature: HIJSMM301DXQCX.40.83.H06.1.454.light.4.raw

SEQ ID NO: 581357 - DNA, 504 bp, Homo sapiens
  misc_feature: HIJSMM301ESWG4.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcccaaccccactgtcta

SEQ ID NO: 581358 - DNA, 499 bp, Homo sapiens
  misc_feature: HIJSMM301A12NZ.49.29.C07.1.454.light.4.raw
agtcgagagacacgaccggtgctcgatttagagtgctacgaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 581359 - DNA, 486 bp, Homo sapiens; identical to SEQ ID NO: 557950
  misc_feature: HIJSMM301EPM49.15.1.A01.1.454.light.4.raw

SEQ ID NO: 581360 - DNA, 494 bp, Homo sapiens
  misc_feature: HIJSMM301CY3PP.11.59.F04.1.454.light.4.raw
  modified_base (107)..(107): a, c, t, g, unknown or other
cgagagataccacgaccggtgctcgatttagtacacacacttaggggctggggtctcaggaggcagcactctcgggacgtctccaccatggcctgggctctgctccncctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtcctaggtcagcccaaggccaaccca

SEQ ID NO: 581361 - DNA, 495 bp, Homo sapiens; identical to SEQ ID NO: 550692
  misc_feature: HIJSMM301CL6SL.3.33.C11.1.454.light.4.raw

SEQ ID NO: 581362 - DNA, 497 bp, Homo sapiens; identical to SEQ ID NO: 538030
  misc_feature: HIJSMM301CBIEW.40.23.C01.1.454.light.4.raw

SEQ ID NO: 581363 - DNA, 485 bp, Homo sapiens; identical to SEQ ID NO: 536799
  misc_feature: HIJSMM301EMTST.19.71.G05.1.454.light.4.raw

SEQ ID NO: 581364 - DNA, 519 bp, Homo sapiens
  misc_feature: HIJSMM301B034H.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacgggaccgaacggtaggaaagtacgaagacgaacctagtggcgtgcgaccactctcgtcttctactcttcccgt

SEQ ID NO: 581365 - DNA, 474 bp, Homo sapiens; identical to SEQ ID NO: 543944
  misc_feature: HIJSMM301EL9JN.5.70.G04.1.454.light.4.raw

SEQ ID NO: 581366 - DNA, 485 bp, Homo sapiens; identical to SEQ ID NO: 535648
  misc_feature: HIJSMM301AOG2D.17.36.D03.1.454.light.4.raw

SEQ ID NO: 581367 - DNA, 504 bp, Homo sapiens; identical to SEQ ID NO: 537401
  misc_feature: HIJSMM301CU0T8.51.23.C01.1.454.light.4.raw

SEQ ID NO: 581368 - DNA, 433 bp, Homo sapiens
  misc_feature: HIJSMM301DLMG3.18.5.A05.1.454.light.4.raw
tacgagtatgcacgaccggtgctcgatttagatagatagacagggtggaaggagactgggacatccagatgacccagtctccttccaccctgtctgcatctgtaggagacagagtcaccatctcttgccgggccactcagagtattagtatctggttggcctggtatcagcagaaaccagggaaagcccctaagctcctgatcgagaaggcgtctagtttagaaagtggggtcccatcaaggtttagcggcagtggatctgggacagaattcactctcaccatcagcagcctgcagcctgatgattttgcaacttattactgccaacattataatacttattcgtacacttttggccaggggaccaagctggagatcaaacgaactgtggctgcaccatctgcttcatcttcccgccatctgacatactcgta

SEQ ID NO: 581369 - DNA, 487 bp, Homo sapiens
  misc_feature: HIJSMM301CXOCL.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcagacccc

SEQ ID NO: 581370 - DNA, 488 bp, Homo sapiens
  misc_feature: HIJSMM301D39KV.3.33.C11.1.454.light.4.raw
  modified_base (478)..(478): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccnccctcctcga

SEQ ID NO: 581371 - DNA, 486 bp, Homo sapiens; identical to SEQ ID NO: 535385
  misc_feature: HIJSMM301CVWA0.19.71.G05.1.454.light.4.raw

SEQ ID NO: 581372 - DNA, 504 bp, Homo sapiens
  misc_feature: HIJSMM301CSBLW.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttacgggcggagggaccaaactgaccgtcctaggtcagcccaa

SEQ ID NO: 581373 - DNA, 517 bp, Homo sapiens
  misc_feature: HIJSMM301ASII3.9.2.A02.1.454.light.4.raw
tgatacgtctcacgaccggtgctcgatttagactcatctacaggggggggtctcaggaggcagcgctctcggaacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccaccct

SEQ ID NO: 581374 - DNA, 485 bp, Homo sapiens; identical to SEQ ID NO: 535606
  misc_feature: HIJSMM301AYTPG.47.46.E02.1.454.light.4.raw

SEQ ID NO: 581375 - DNA, 521 bp, Homo sapiens; identical to SEQ ID NO: 538715
  misc_feature: HIJSMM301B7ASU.27.23.C01.1.454.light.4.raw

SEQ ID NO: 581376 - DNA, 527 bp, Homo sapiens
  misc_feature: HIJSMM301EWP6F.17.75.G09.1.454.light.4.raw
cgtagactagcacgaccggtgctcgatttagtatagacatcaggggctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaaagctgccctgaccctaacgggggcgcagcctgaggacgaggccgactattattgcctactatcatttgatggtggtcgtctgcccattttcggcggcgggaccagggtggccgtcctgggtcagcccaaggctgccccctcggtcactctgttcccgcctccctacctagtctacg

SEQ ID NO: 581377 - DNA, 496 bp, Homo sapiens; identical to SEQ ID NO: 549958
  misc_feature: HIJSMM301DAJ2M.10.25.C03.1.454.light.4.raw

SEQ ID NO: 581378 - DNA, 505 bp, Homo sapiens; identical to SEQ ID NO: 536792
  misc_feature: HIJSMM301ALGDV.48.33.C11.1.454.light.4.raw

SEQ ID NO: 581379 - DNA, 513 bp, Homo sapiens
  misc_feature: HIJSMM301EKQXC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcatggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtccactctcgttcccaccct

SEQ ID NO: 581380 - DNA, 496 bp, Homo sapiens; identical to SEQ ID NO: 538149
  misc_feature: HIJSMM301BTALN.13.67.G01.1.454.light.4.raw

SEQ ID NO: 581381 - DNA, 495 bp, Homo sapiens
  misc_feature: HIJSMM301B4AC0.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgactgtggctgcaca

SEQ ID NO: 581382 - DNA, 519 bp, Homo sapiens
  misc_feature: HIJSMM301EW61K.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctggtcacctgtccacctcct

SEQ ID NO: 581383 - DNA, 502 bp, Homo sapiens; identical to SEQ ID NO: 542915
  misc_feature: HIJSMM301A4FX4.12.48.E04.1.454.light.4.raw

SEQ ID NO: 581384 - DNA, 509 bp, Homo sapiens
  misc_feature: HIJSMM301DS85P.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattatactgtgcaccgtgggatgacatcctgaatggtccggtgttcggcggagggaccaggctgaccgtcctaagtcagcccaaggcctgccccctc

SEQ ID NO: 581385 - DNA, 486 bp, Homo sapiens; identical to SEQ ID NO: 535523
  misc_feature: HIJSMM301AS7II.22.73.G07.1.454.light.4.raw

SEQ ID NO: 581386 - DNA, 507 bp, Homo sapiens; identical to SEQ ID NO: 559118
  misc_feature: HIJSMM301EFUTX.17.87.H10.1.454.light.4.raw

SEQ ID NO: 581387 - DNA, 487 bp, Homo sapiens; identical to SEQ ID NO: 541889
  misc_feature: HIJSMM301CWSBT.26.23.C01.1.454.light.4.raw

SEQ ID NO: 581388 - DNA, 496 bp, Homo sapiens; identical to SEQ ID NO: 537925
  misc_feature: HIJSMM301C76IN.22.14.B03.1.454.light.4.raw

SEQ ID NO: 581389 - DNA, 499 bp, Homo sapiens; identical to SEQ ID NO: 536030
  misc_feature: HIJSMM301AYE7V.48.23.C01.1.454.light.4.raw

SEQ ID NO: 581390 - DNA, 494 bp, Homo sapiens; identical to SEQ ID NO: 537153
  misc_feature: HIJSMM301DTZEL.11.59.F04.1.454.light.4.raw

SEQ ID NO: 581391 - DNA, 491 bp, Homo sapiens
  misc_feature: HIJSMM301EXS2W.10.17.B06.1.454.light.4.raw
catagtagtgcacgaccggtgctcgatttagtcgatagtgaaggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttgccgggggaccaagctggaaatcaagcgaactgtggctgcaccatctgtcttcatt

SEQ ID NO: 581392 - DNA, 499 bp, Homo sapiens; identical to SEQ ID NO: 537739
  misc_feature: HIJSMM301CWM43.12.86.H09.1.454.light.4.raw

SEQ ID NO: 581393 - DNA, 442 bp, Homo sapiens
  misc_feature: HIJSMM301AO2HY.11.3.A03.1.454.light.4.raw
  modified_base (75)..(75): a, c, t, g, unknown or other
cgagagataccacgaccggtgctcgatttagagagcgtcacagggtcctgggcccagtctgtgctgacgcagccnccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccgaccctcctcgtatctctcg

SEQ ID NO: 581394 - DNA, 508 bp, Homo sapiens; identical to SEQ ID NO: 541908
  misc_feature: HIJSMM301BLIWD.47.85.H08.1.454.light.4.raw

SEQ ID NO: 581395 - DNA, 506 bp, Homo sapiens; identical to SEQ ID NO: 534969
  misc_feature: HIJSMM301A3XAZ.18.37.D04.1.454.light.4.raw

SEQ ID NO: 581396 - DNA, 487 bp, Homo sapiens; identical to SEQ ID NO: 536206
  misc_feature: HIJSMM301ALKAA.47.38.D05.1.454.light.4.raw

SEQ ID NO: 581397 - DNA, 492 bp, Homo sapiens; identical to SEQ ID NO: 535673
  misc_feature: HIJSMM301C6MUK.49.66.F11.1.454.light.4.raw

SEQ ID NO: 581398 - DNA, 518 bp, Homo sapiens
  misc_feature: HIJSMM301B215U.41.19.B08.1.454.light.4.raw
tctatactatcacgaccggtgctcgatttagtgagtcagtaaggggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacacccggcgaagcccccagactcataatttatgatgtcactgatcggccctcaggggtttctaatcgcttctctggctccaagtccggcgacacggcctccctgaccatctccggcctccaggcggaggacgagggtgattattctgcagctcatttacaaccagccacaccttgctcttcggaactgggaccacggtcatcgtcctaggtcagcccaaggccaaccccactgtcactctgttcccaccctcctcat

SEQ ID NO: 581399 - DNA, 508 bp, Homo sapiens
  misc_feature: HIJSMM301EVW9Z.48.15.B04.1.454.light.4.raw
agtatacatacacgaccggtgctcgatttagacagtatatatccgcggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagttttattactgtcaacaatattattctactccgccgacgttcggccggggaccaacgtggaaatacaaacgaactgtggctgcaccatctgtcttcta

SEQ ID NO: 581400 - DNA, 519 bp, Homo sapiens
  misc_feature: HIJSMM301CULAC.48.70.G04.1.454.light.4.raw
agtatacatacacgaccggtgctcgatttagtgtagtgtgaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccct

SEQ ID NO: 581401 - DNA, 491 bp, Homo sapiens
  misc_feature: HIJSMM301EMOPJ.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatcaccttcggccaagggacacgactggagattaaacgaactgtgctgcaccatctgtcttcatt

SEQ ID NO: 581402 - DNA, 509 bp, Homo sapiens; identical to SEQ ID NO: 553073
  misc_feature: HIJSMM301AKBZI.16.1.A01.1.454.light.4.raw

SEQ ID NO: 581403 - DNA, 482 bp, Homo sapiens
  misc_feature: HIJSMM301EMQXQ.48.34.D01.1.454.light.4.raw
agtatacatacacgaccggtgctcgatttagatcgtctgtgttgggtttgggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcacttgccgggcaagtcaggacattaaaagtgatttagcctggtatcagcagaaaccagggagagcccctaagctcctcatctatgctgcttccattttacaaagtggagtctcatcaaggttcagcggcggtggatctggcacagatttcactctcaccatcagcagcctgcagcctgaagattttgcaacttattactgtctgcacgattacaattaccctcggacgttcggccaagggaccaaggtggaagtcaacgaactgtggctgcacca

SEQ ID NO: 581404 - DNA, 494 bp, Homo sapiens
  misc_feature: HIJSMM301BPYLY.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggaggatcaaacgaactgtggctgcaccatctgt

SEQ ID NO: 581405 - DNA, 499 bp, Homo sapiens; identical to SEQ ID NO: 538774
  misc_feature: HIJSMM301DHPIA.26.26.C04.1.454.light.4.raw

SEQ ID NO: 581406 - DNA, 505 bp, Homo sapiens; identical to SEQ ID NO: 554737
  misc_feature: HIJSMM301EAV6O.40.67.G01.1.454.light.4.raw

SEQ ID NO: 581407 - DNA, 497 bp, Homo sapiens
  misc_feature: HIJSMM301CBL3Q.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgtggacgaggctgattattactgcagctcatatacaagcaccagcactctctatgtcttcggaactgggaccaaggtcaccgtcctaagtcagcccaagg

SEQ ID NO: 581408 - DNA, 480 bp, Homo sapiens; identical to SEQ ID NO: 554452
  misc_feature: HIJSMM301B8K6Y.41.17.B06.1.454.light.4.raw

SEQ ID NO: 581409 - DNA, 491 bp, Homo sapiens; identical to SEQ ID NO: 547543
  misc_feature: HIJSMM301AV963.40.11.A11.1.454.light.4.raw

SEQ ID NO: 581410 - DNA, 517 bp, Homo sapiens
  misc_feature: HIJSMM301AU8W0.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtccactctgttcccaccctcctccg

SEQ ID NO: 581411 - DNA, 517 bp, Homo sapiens; identical to SEQ ID NO: 536262
  misc_feature: HIJSMM301AHX0B.14.70.G04.1.454.light.4.raw

SEQ ID NO: 581412 - DNA, 491 bp, Homo sapiens; identical to SEQ ID NO: 537594
  misc_feature: HIJSMM301BHI3K.4.24.C02.1.454.light.4.raw

SEQ ID NO: 581413 - DNA, 480 bp, Homo sapiens; identical to SEQ ID NO: 535291
  misc_feature: HIJSMM301AH98Q.22.59.F04.1.454.light.4.raw

SEQ ID NO: 581414 - DNA, 496 bp, Homo sapiens
  misc_feature: HIJSMM301DDVBS.47.62.F07.1.454.light.4.raw
  modified_base (465)..(465): a, c, t, g, unknown or other
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagatttttactttctaccactcagcagcctgcagcctgaagatattgtcaacatattactgttcaacagtatcataatctcccaccttcgtccgtccggacgaacgtagagtatnaacaacaagtggtcgtgtcaccactactctt

SEQ ID NO: 581415 - DNA, 486 bp, Homo sapiens; identical to SEQ ID NO: 535043
  misc_feature: HIJSMM301DFZ5E.46.35.D02.1.454.light.4.raw

SEQ ID NO: 581416 - DNA, 501 bp, Homo sapiens
  misc_feature: HIJSMM301CWTAW.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagtaccagcactctctatgtcttcggaactgggaccaaggtcaccgtcctaggtcagcccaaggccaa

SEQ ID NO: 581417 - DNA, 515 bp, Homo sapiens
  misc_feature: HIJSMM301AHDCF.41.87.H10.1.454.light.4.raw
tctatactatcacgaccggtgctcgatttagcagtactgcgttgggtttgggggggcctaaggaagcagcactggtggtgcctcagccatggcctggaccgttctcctcctcggcctcctctctcactgcacagcctctgtgacctcctatgtgttgactcagccaccctcggcgtcagtggccctaggacagacggccaggattacctgtggggcaaataagataggaactacaaatgtgcactggtaccaacagaggccaggccaggcccctgtggtggtcgtccatgatgattacgaccggccctcaggaatccctgagcgattctctggctccaattctgggaacacggccaccctgaccatcaccggggtcgaggccggggatgaggccacctactattgtcacgtctgggagactggtgatgatcctgtggcgctattcggcggagggacgaagctgaccgtcctgggtcagcccaaggctgccccctcggtcactctgttcccgccct

SEQ ID NO: 581418 - DNA, 519 bp, Homo sapiens; identical to SEQ ID NO: 557142
  misc_feature: HIJSMM301ATTB1.19.80.H03.1.454.light.4.raw

SEQ ID NO: 581419 - DNA, 517 bp, Homo sapiens
  misc_feature: HIJSMM301AMFGO.40.12.B01.1.454.light.4.raw
tctagcgactcacgaccggtgctcgatttagtagtgtagattccgcggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctcggtcactctcgttcccta

SEQ ID NO: 581420 - DNA, 493 bp, Homo sapiens; identical to SEQ ID NO: 540127
  misc_feature: HIJSMM301B59LS.10.17.B06.1.454.light.4.raw

SEQ ID NO: 581421 - DNA, 489 bp, Homo sapiens
  misc_feature: HIJSMM301EGKJ8.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagagtacaaacgaa

SEQ ID NO: 581422 - DNA, 490 bp, Homo sapiens; identical to SEQ ID NO: 536481
  misc_feature: HIJSMM301CQ9S5.13.46.E02.1.454.light.4.raw

SEQ ID NO: 581423 - DNA, 493 bp, Homo sapiens
  misc_feature: HIJSMM301EYWOB.22.25.C03.1.454.light.4.raw
acatacgcgtcacgaccggtgctcgatttagtagtgtagatttgggtttgggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagttaccatcacttgccgggccagtcagagtattagtgtctgggtggcctggtatcagcagaaaccagggaaagcccctaaggtcctgatctatgaggcatctactttaaaaactggtgtcccatcaaggttcagcggcagtggatctgggacagaattcactctcgccatcagcagcctgcagcctgatgattctgcaacttattactgccaacagtattatagttaatcgggggacgttcggccaagggaccaaggtggaaatcaaacgaactgtggctgcaccatctgt

SEQ ID NO: 581424 - DNA, 486 bp, Homo sapiens
  misc_feature: HIJSMM301AJO85.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 581425 - DNA, 493 bp, Homo sapiens; identical to SEQ ID NO: 549967
  misc_feature: HIJSMM301BQZ2Q.10.20.B09.1.454.light.4.raw

SEQ ID NO: 581426 - DNA, 502 bp, Homo sapiens
  misc_feature: HIJSMM301BU8F9.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaaacgaactagtggctgcaccatctgtcttcat

SEQ ID NO: 581427 - DNA, 489 bp, Homo sapiens
  misc_feature: HIJSMM301EL4GO.41.53.E09.1.454.light.4.raw
tctatactatcacgaccggtgctcgatttagagagagtgtgttgggtttgggggggtctcaggaggcagcgctctcgggacgtctccaccatggcctgggctctgctattcctcaccctcctcactcagggcacagggtcctgggcccagtctgctctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagccc

SEQ ID NO: 581428 - DNA, 495 bp, Homo sapiens
  misc_feature: HIJSMM301EJ752.22.57.F02.1.454.light.4.raw
  modified_base (472)..(472): a, c, t, g, unknown or other
acatacgcgtcacgaccggtgctcgatttagctcgatatagttgggtttgggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactntggctgcaccatctgtcttcatt

SEQ ID NO: 581429 - DNA, 434 bp, Homo sapiens; identical to SEQ ID NO: 535153
  misc_feature: HIJSMM301DYB63.18.5.A05.1.454.light.4.raw

SEQ ID NO: 581430 - DNA, 494 bp, Homo sapiens
  misc_feature: HIJSMM301CRP02.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggccaaggtggagatcaaacgaactgtggctgcaccatctgtcttcatcttcccgcc

SEQ ID NO: 581431 - DNA, 503 bp, Homo sapiens
  misc_feature: HIJSMM301CKZ0Z.18.26.C04.1.454.light.4.raw
  modified_base (476)..(476): a, c, t, g, unknown or other
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatcgacccagtctccatcttccgtggctgcctctgtaggagacagagtcagcatcacttgtcggacgagtcaacatattagcttggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatacaaaggaactgtggntgcaccatctgtctcatctcccgccgt

SEQ ID NO: 581432 - DNA, 505 bp, Homo sapiens
  misc_feature: HIJSMM301ALOCS.21.22.B11.1.454.light.4.raw
  modified_base (431)..(431): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacncaacatgggatgacaatctgagcgggttgggtgttcggcggagggaccaaactgaccgtcctaggtcagcccaa

SEQ ID NO: 581433 - DNA, 504 bp, Homo sapiens; identical to SEQ ID NO: 540538
  misc_feature: HIJSMM301CCH6F.7.71.G05.1.454.light.4.raw

SEQ ID NO: 581434 - DNA, 490 bp, Homo sapiens; identical to SEQ ID NO: 535526
  misc_feature: HIJSMM301DHY5S.26.78.H01.1.454.light.4.raw

SEQ ID NO: 581435 - DNA, 508 bp, Homo sapiens
  misc_feature: HIJSMM301DVNIV.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaagctgccccctcggtcactctgtt

SEQ ID NO: 581436 - DNA, 511 bp, Homo sapiens
  misc_feature: HIJSMM301ENJ7N.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggcctgccccctcggtcactctcgtt

SEQ ID NO: 581437 - DNA, 504 bp, Homo sapiens; identical to SEQ ID NO: 539690
  misc_feature: HIJSMM301AVDG6.47.65.F10.1.454.light.4.raw

SEQ ID NO: 581438 - DNA, 487 bp, Homo sapiens; identical to SEQ ID NO: 557907
  misc_feature: HIJSMM301B3X48.5.40.D07.1.454.light.4.raw

SEQ ID NO: 581439 - DNA, 500 bp, Homo sapiens
  misc_feature: HIJSMM301DJ50E.9.12.B01.1.454.light.4.raw
  modified_base (427)..(427): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccgggtccctgaccgattcagtggcagcgggtctgggacagatttcactctcaccatcagcagcctgcaggctgaagatgtggcagtttatactgtcaacagttttcncgggcgtcggcaagggaccaaggtggaaatcaaacgaactagtggactgcaccatctgtcttcatcttccccg

SEQ ID NO: 581440 - DNA, 496 bp, Homo sapiens
  misc_feature: HIJSMM301BTQXT.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagataccattggagaaagagtgatgacgcagtctccagccaccctgtctgtgtctccaggggaaagcgccactctctcctgcagggacagccagactgttagcaccaacttagcctggtatcagcagaaacctggccagtctcccaggctcctcatctatggtgcatccaccagggcccctggtgtcccagccaggttcagtggcagtgggtctgggacagagttcactctcaccatcagcggcctgcagtctgaagattttgcagtttattactgtcagcagtataattactggccgccgacgttcggccaagggaccaaggtggaaatcaaacgaactgtggctgcaccatctgtcttcta

SEQ ID NO: 581441 - DNA, 508 bp, Homo sapiens
  misc_feature: HIJSMM301ANE1M.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccaaggtggcaatcaaccgaactagtggctgcaccatctgtcttcatcttcccgccact

SEQ ID NO: 581442 - DNA, 502 bp, Homo sapiens; identical to SEQ ID NO: 537816
  misc_feature: HIJSMM301CWPAW.19.78.H01.1.454.light.4.raw

SEQ ID NO: 581443 - DNA, 472 bp, Homo sapiens
  misc_feature: HIJSMM301D6X6N.5.70.G04.1.454.light.4.raw
atcagacacgcacgaccggtgctcgatttagtgtagtgtgaagggaaagggggcaggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagatttgcaacttactttgtcaacaggctcagagtttcccgctcacttttcggcggagggaccaaggtggaggatcaaacgaa

SEQ ID NO: 581444 - DNA, 502 bp, Homo sapiens; identical to SEQ ID NO: 540270
  misc_feature: HIJSMM301BJCTD.27.78.H01.1.454.light.4.raw

SEQ ID NO: 581445 - DNA, 508 bp, Homo sapiens
  misc_feature: HIJSMM301DHP5I.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtcctgaccgattccgtggcagcgggtctgggacagacttcactctcaccatcagtagcctgcagcctgaagatgtggcaacttattactgtcaacaatttcgttatactccgccgacgttcggccggggaccaccgtggaaatacaaacgaaactgtggctgcaccatctgtctt

SEQ ID NO: 581446 - DNA, 501 bp, Homo sapiens; identical to SEQ ID NO: 548482
  misc_feature: HIJSMM301B2WPU.41.71.G05.1.454.light.4.raw

SEQ ID NO: 581447 - DNA, 505 bp, Homo sapiens; identical to SEQ ID NO: 557888
  misc_feature: HIJSMM301CMYJA.5.24.C02.1.454.light.4.raw

SEQ ID NO: 581448 - DNA, 504 bp, Homo sapiens; identical to SEQ ID NO: 535561
  misc_feature: HIJSMM301BLLHE.4.57.F02.1.454.light.4.raw

SEQ ID NO: 581449 - DNA, 506 bp, Homo sapiens
  misc_feature: HIJSMM301CUXCW.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcgggagggaccaaaatagaggtcgaaacgaactagtggctgcaccatctgtcttcatt

SEQ ID NO: 581450 - DNA, 494 bp, Homo sapiens; identical to SEQ ID NO: 554289
  misc_feature: HIJSMM301EN6LX.13.5.A05.1.454.light.4.raw

SEQ ID NO: 581451 - DNA, 494 bp, Homo sapiens
  misc_feature: HIJSMM301CM4A4.43.73.G07.1.454.light.4.raw
tgtgagtagtcacgaccggtgctcgatttagctctacgctcagggggagagactgaagaacccagcattgcagcagctccaccatggcctgggctcctctgctcctcaccctcctcagtctcctcacagggtccctctcccagcttgtgctgactcagccaccttctgcatcagcctccctgggagcctcggtcacactcacctgcaccctgagcagcggctacaatgaatataaggtggactggtaccaacagagaccaggggagtgcccccgatttgtgatgcgagtgggcccggatgggatggcgggatccaagggggatggcatccctgatcggttctcagtcttgggctcaggcctgactcggtccctgaccatcaacaacatccaggaagaggatgacagtgactactactgtgggacgaattatggcagtgggaatacctacatgtatgtctttggaagtggacgaaggtcaccgtccaaggtcacg

SEQ ID NO: 581452 - DNA, 488 bp, Homo sapiens
  misc_feature: HIJSMM301EAH36.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtatcccggccagattcagtggcagggggtctgggacagaattcactctcaccatcaccagcctgcagtctgagatttgcagtctattactgtcagcaatataattactggctctctttcggcgggggaccaagctggagatcaaccgaactgtggctgcaccatctgtcttcat

SEQ ID NO: 581453 - DNA, 497 bp, Homo sapiens; identical to SEQ ID NO: 535740
  misc_feature: HIJSMM301AJ8DV.3.71.G05.1.454.light.4.raw

SEQ ID NO: 581454 - DNA, 507 bp, Homo sapiens; identical to SEQ ID NO: 535930
  misc_feature: HIJSMM301EOTUM.15.34.D01.1.454.light.4.raw

SEQ ID NO: 581455 - DNA, 501 bp, Homo sapiens; identical to SEQ ID NO: 538461
  misc_feature: HIJSMM301BBKMV.13.11.A11.1.454.light.4.raw

SEQ ID NO: 581456 - DNA, 486 bp, Homo sapiens
  misc_feature: HIJSMM301BCVE8.26.55.E11.1.454.light.4.raw
  modified_base (469)..(469): a, c, t, g, unknown or other
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacnggaactgtggctgcacc

SEQ ID NO: 581457 - DNA, 486 bp, Homo sapiens; identical to SEQ ID NO: 535043
  misc_feature: HIJSMM301DYWEF.46.35.D02.1.454.light.4.raw

SEQ ID NO: 581458 - DNA, 480 bp, Homo sapiens
  misc_feature: HIJSMM301CV19T.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacacaccctgcgtggttttggctgttcggcggcgggacc

SEQ ID NO: 581459 - DNA, 441 bp, Homo sapiens; identical to SEQ ID NO: 550529
  misc_feature: HIJSMM301CUU44.41.9.A09.1.454.light.4.raw

SEQ ID NO: 581460 - DNA, 489 bp, Homo sapiens
  misc_feature: HIJSMM301BY9VI.51.28.C06.1.454.light.4.raw
cgatcgtatacacgaccggtgctcgatttagagctcacgtattgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcggggggaccaagctgaccgtcctcggtcagcccaaggctgccccctcgg

SEQ ID NO: 581461 - DNA, 508 bp, Homo sapiens
  misc_feature: HIJSMM301EDU3Z.43.34.D01.1.454.light.4.raw
tgtgagtagtcacgaccggtgctcgatttagatcgtctgtgttgggtttggggtctgtgttgggtttggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcgcgggaccaagctgaccgtcctaggtcagcccaaggctcg

SEQ ID NO: 581462 - DNA, 518 bp, Homo sapiens; identical to SEQ ID NO: 563314
  misc_feature: HIJSMM301AUU59.14.70.G04.1.454.light.4.raw

SEQ ID NO: 581463 - DNA, 491 bp, Homo sapiens; identical to SEQ ID NO: 536000
  misc_feature: HIJSMM301A60AW.48.1.A01.1.454.light.4.raw

SEQ ID NO: 581464 - DNA, 502 bp, Homo sapiens
  misc_feature: HIJSMM301BCKBQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtaggataatcagacgaaactcgtggtcgtg

SEQ ID NO: 581465 - DNA, 505 bp, Homo sapiens; identical to SEQ ID NO: 549187
  misc_feature: HIJSMM301DE42W.12.53.E09.1.454.light.4.raw

SEQ ID NO: 581466 - DNA, 488 bp, Homo sapiens; identical to SEQ ID NO: 535725
  misc_feature: HIJSMM301CUXYC.12.88.H11.1.454.light.4.raw

SEQ ID NO: 581467 - DNA, 444 bp, Homo sapiens; identical to SEQ ID NO: 537971
  misc_feature: HIJSMM301D440X.2.76.G10.1.454.light.4.raw

SEQ ID NO: 581468 - DNA, 494 bp, Homo sapiens; identical to SEQ ID NO: 534992
  misc_feature: HIJSMM301BH6K2.9.1.A01.1.454.light.4.raw

SEQ ID NO: 581469 - DNA, 507 bp, Homo sapiens
  misc_feature: HIJSMM301AHM2O.3.79.H02.1.454.light.4.raw
agacgcactccacgaccggtgctcgatttagtgtcacacgaagggaaaggggggggtcgtcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 581470 - DNA, 495 bp, Homo sapiens
  misc_feature: HIJSMM301B5QSW.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctcttgacgttcggccaagggaccaaggtggagatcaaacgaactgtggctgcaccat

SEQ ID NO: 581471 - DNA, 481 bp, Homo sapiens; identical to SEQ ID NO: 535993
  misc_feature: HIJSMM301C5V2M.21.25.C03.1.454.light.4.raw

SEQ ID NO: 581472 - DNA, 494 bp, Homo sapiens
  misc_feature: HIJSMM301AHA8E.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcccttctcccccctacaatttcggtcaggggaccaagttgaacatcaatcgaactgtggctgcaccatctgtctt

SEQ ID NO: 581473 - DNA, 454 bp, Homo sapiens; identical to SEQ ID NO: 534964
  misc_feature: HIJSMM301EV2M3.19.86.H09.1.454.light.4.raw

SEQ ID NO: 581474 - DNA, 492 bp, Homo sapiens
  misc_feature: HIJSMM301B860M.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggtagggaccaaggtggagatcaaacgaa

SEQ ID NO: 581475 - DNA, 508 bp, Homo sapiens
  misc_feature: HIJSMM301B5VL4.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggtcgggacccagatgactgtcctcagtcagcccaaggctgccccctcggt

SEQ ID NO: 581476 - DNA, 484 bp, Homo sapiens; identical to SEQ ID NO: 535240
  misc_feature: HIJSMM301D1HNV.47.60.F05.1.454.light.4.raw

SEQ ID NO: 581477 - DNA, 484 bp, Homo sapiens; identical to SEQ ID NO: 535240
  misc_feature: HIJSMM301DH5WX.47.60.F05.1.454.light.4.raw

SEQ ID NO: 581478 - DNA, 507 bp, Homo sapiens
  misc_feature: HIJSMM301EMBXJ.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtctaggtcagcccaaggctgccccctggtcactctgtcccgccctcc

SEQ ID NO: 581479 - DNA, 487 bp, Homo sapiens; identical to SEQ ID NO: 546877
  misc_feature: HIJSMM301EEEAW.41.44.D11.1.454.light.4.raw

SEQ ID NO: 581480 - DNA, 513 bp, Homo sapiens; identical to SEQ ID NO: 539258
  misc_feature: HIJSMM301EPEHT.43.19.B08.1.454.light.4.raw

SEQ ID NO: 581481 - DNA, 494 bp, Homo sapiens; identical to SEQ ID NO: 540664
  misc_feature: HIJSMM301BKM6U.47.64.F09.1.454.light.4.raw

SEQ ID NO: 581482 - DNA, 378 bp, Homo sapiens; identical to SEQ ID NO: 577487
  misc_feature: HIJSMM301A8SMV.49.42.D09.1.454.light.4.raw

SEQ ID NO: 581483 - DNA, 469 bp, Homo sapiens; identical to SEQ ID NO: 556699
  misc_feature: HIJSMM301BOZCV.7.81.H04.1.454.light.4.raw

SEQ ID NO: 581484 - DNA, 482 bp, Homo sapiens
  misc_feature: HIJSMM301D737K.51.78.H01.1.454.light.4.raw
cgatcgtatacacgaccggtgctcgatttagtgtgagtagtttgggtttggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacgacgtaccctcacgctactacgtttcggcgggacggaaccgaggtaggagatacaaacgaa

SEQ ID NO: 581485 - DNA, 494 bp, Homo sapiens; identical to SEQ ID NO: 534992
  misc_feature: HIJSMM301BTIGF.9.1.A01.1.454.light.4.raw

SEQ ID NO: 581486 - DNA, 496 bp, Homo sapiens; identical to SEQ ID NO: 541772
  misc_feature: HIJSMM301CBGN7.51.81.H04.1.454.light.4.raw

SEQ ID NO: 581487 - DNA, 521 bp, Homo sapiens
  misc_feature: HIJSMM301BHX9A.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccctcggtcactctgttcccaccct

SEQ ID NO: 581488 - DNA, 493 bp, Homo sapiens; identical to SEQ ID NO: 536007
  misc_feature: HIJSMM301AIVGN.27.78.H01.1.454.light.4.raw

SEQ ID NO: 581489 - DNA, 473 bp, Homo sapiens; identical to SEQ ID NO: 535262
  misc_feature: HIJSMM301DY2NI.8.67.G01.1.454.light.4.raw

SEQ ID NO: 581490 - DNA, 504 bp, Homo sapiens; identical to SEQ ID NO: 535077
  misc_feature: HIJSMM301C13A2.8.28.C06.1.454.light.4.raw

SEQ ID NO: 581491 - DNA, 486 bp, Homo sapiens; identical to SEQ ID NO: 535043
  misc_feature: HIJSMM301EKVG1.46.35.D02.1.454.light.4.raw

SEQ ID NO: 581492 - DNA, 482 bp, Homo sapiens; identical to SEQ ID NO: 539800
  misc_feature: HIJSMM301BUZOC.21.25.C03.1.454.light.4.raw

SEQ ID NO: 581493 - DNA, 508 bp, Homo sapiens
  misc_feature: HIJSMM301D7UIQ.43.69.G03.1.454.light.4.raw
tgtgagtagtcacgaccggtgctcgatttagtcgctgcgtaaaggagaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattaattgtcaagcagtagacagcagtggtccttatcgggtggttcggcgggggaccgaaggctgaccgtcctaggtcagcccaaggcctgccccctccggtccta

SEQ ID NO: 581494 - DNA, 387 bp, Homo sapiens
  misc_feature: HIJSMM301CP2W0.49.55.E11.1.454.light.4.raw
agtcgagagacacgaccggtgctcgatttagcactcgcacgttgggtttggggtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagatttttactttcaccatcagcagcctgcagcctgaagatattgcaacatattactgtcaacagtatgatagtctcccgctcactttcggcggagggaccaaggtggagatcaaacgaactgtggctgcaccatctgtcttcatcttcccgcccatctgatctctcgact

SEQ ID NO: 581495 - DNA, 488 bp, Homo sapiens; identical to SEQ ID NO: 557329
  misc_feature: HIJSMM301BR2R7.4.33.C11.1.454.light.4.raw

SEQ ID NO: 581496 - DNA, 507 bp, Homo sapiens
  misc_feature: HIJSMM301EBDOX.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtccccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 581497 - DNA, 503 bp, Homo sapiens; identical to SEQ ID NO: 538973
  misc_feature: HIJSMM301AZI0X.5.86.H09.1.454.light.4.raw

SEQ ID NO: 581498 - DNA, 516 bp, Homo sapiens
  misc_feature: HIJSMM301ALPXS.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaagaagtagccctctcgtggttttcggcgggggaccaaggtgaccgtcctaagtcagcccaaggctgccccctcggtcactctgttcccgccct

SEQ ID NO: 581499 - DNA, 484 bp, Homo sapiens; identical to SEQ ID NO: 535400
  misc_feature: HIJSMM301DNQ0V.46.26.C04.1.454.light.4.raw

SEQ ID NO: 581500 - DNA, 481 bp, Homo sapiens
  misc_feature: HIJSMM301CAISC.48.19.B08.1.454.light.4.raw
agtatacatacacgaccggtgctcgatttagtgagtcagtaaaggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtcctaggtcacg

SEQ ID NO: 581501 - DNA, 519 bp, Homo sapiens; identical to SEQ ID NO: 569627
  misc_feature: HIJSMM301DXEO3.27.23.C01.1.454.light.4.raw

SEQ ID NO: 581502 - DNA, 496 bp, Homo sapiens
  misc_feature: HIJSMM301BFV0D.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaagggtggagatcaaacgaactgtggctgcaccatctgtctt

SEQ ID NO: 581503 - DNA, 472 bp, Homo sapiens
  misc_feature: HIJSMM301CE09C.51.37.D04.1.454.light.4.raw
cgatcgtatacacgaccggtgctcgatttagtagcatactgttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaggtggagatcaaacgaa

SEQ ID NO: 581504 - DNA, 501 bp, Homo sapiens
  misc_feature: HIJSMM301CNKPH.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtctggtcagcccaaggctgccccctcggtcta

SEQ ID NO: 581505 - DNA, 482 bp, Homo sapiens; identical to SEQ ID NO: 542083
  misc_feature: HIJSMM301AY440.5.39.D06.1.454.light.4.raw

SEQ ID NO: 581506 - DNA, 498 bp, Homo sapiens
  misc_feature: HIJSMM301EKXQ3.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccgaaggtgaccgtcctacgtcagccaaggctcgccccctcggtcactctcg

SEQ ID NO: 581507 - DNA, 521 bp, Homo sapiens; identical to SEQ ID NO: 538715
  misc_feature: HIJSMM301DL9D5.27.23.C01.1.454.light.4.raw

SEQ ID NO: 581508 - DNA, 504 bp, Homo sapiens
  misc_feature: HIJSMM301EJUPO.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcgccggggaccaacgtggaatcaaacgaactgtggctgcaccatctgtcttcatt

SEQ ID NO: 581509 - DNA, 447 bp, Homo sapiens; identical to SEQ ID NO: 535201
  misc_feature: HIJSMM301DTDEM.18.9.A09.1.454.light.4.raw

SEQ ID NO: 581510 - DNA, 503 bp, Homo sapiens; identical to SEQ ID NO: 568855
  misc_feature: HIJSMM301CIZHM.9.71.G05.1.454.light.4.raw

SEQ ID NO: 581511 - DNA, 508 bp, Homo sapiens; identical to SEQ ID NO: 536388
  misc_feature: HIJSMM301AXIK2.11.57.F02.1.454.light.4.raw

SEQ ID NO: 581512 - DNA, 486 bp, Homo sapiens; identical to SEQ ID NO: 538219
  misc_feature: HIJSMM301DO5KO.47.70.G04.1.454.light.4.raw

SEQ ID NO: 581513 - DNA, 521 bp, Homo sapiens
  misc_feature: HIJSMM301D23VA.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctcgttcccgccctcct

SEQ ID NO: 581514 - DNA, 485 bp, Homo sapiens; identical to SEQ ID NO: 535606
  misc_feature: HIJSMM301AN3MN.47.46.E02.1.454.light.4.raw

SEQ ID NO: 581515 - DNA, 487 bp, Homo sapiens
  misc_feature: HIJSMM301CK849.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggtccgaacggaccgaacggtggaaagtacaaacgaaacctagtgg

SEQ ID NO: 581516 - DNA, 520 bp, Homo sapiens; identical to SEQ ID NO: 579367
  misc_feature: HIJSMM301A17M8.27.23.C01.1.454.light.4.raw

SEQ ID NO: 581517 - DNA, 507 bp, Homo sapiens
  misc_feature: HIJSMM301DWU5A.48.73.G07.1.454.light.4.raw
agtatacatacacgaccggtgctcgatttagctctacgctcagggcacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggt

SEQ ID NO: 581518 - DNA, 486 bp, Homo sapiens; identical to SEQ ID NO: 536261
  misc_feature: HIJSMM301BA74N.26.55.E11.1.454.light.4.raw

SEQ ID NO: 581519 - DNA, 509 bp, Homo sapiens; identical to SEQ ID NO: 539359
  misc_feature: HIJSMM301BWAC9.47.85.H08.1.454.light.4.raw

SEQ ID NO: 581520 - DNA, 500 bp, Homo sapiens
  misc_feature: HIJSMM301AOD64.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatgtcggcgggaggaaccaactcgaccgtccgtaggtcacgacccaaggctccg

SEQ ID NO: 581521 - DNA, 502 bp, Homo sapiens
  misc_feature: HIJSMM301DTJ9U.40.69.G03.1.454.light.4.raw
tctagcgactcacgaccggtgctcgatttagtcgctgcgtaaaggagaaagggggaggaactgctcagttaggacccagacggaaccatggaagccccagctcagcttctcttcctcctgctactctggctcccagataccaccggagaaattgtgttgacacagtctccagccaccctgtctttgtctccagggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagacttttgctagtttattactgttcagcagcgtaccaactcggccgctcactttcggcggagggaccgaaggtggagatacaaacgaactgtggctgcaccatctgtcttc

SEQ ID NO: 581522 - DNA, 510 bp, Homo sapiens; identical to SEQ ID NO: 535855
  misc_feature: HIJSMM301BP8EG.17.33.C11.1.454.light.4.raw

SEQ ID NO: 581523 - DNA, 514 bp, Homo sapiens
  misc_feature: HIJSMM301CYSUW.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagttttattactgtcaacagcgtagcagcaggcctccggcgacgttcggccaagggaccaaggtggaagtcaagcgaactgtggctgcaccatctgtcttcatcttcccgccta

SEQ ID NO: 581524 - DNA, 494 bp, Homo sapiens; identical to SEQ ID NO: 535828
  misc_feature: HIJSMM301EXA2M.3.36.D03.1.454.light.4.raw

SEQ ID NO: 581525 - DNA, 524 bp, Homo sapiens
  misc_feature: HIJSMM301CSG0S.53.77.G11.1.454.light.4.raw
cgcgtatacacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtctaggtcagcccaaggctcgccccctcggtcactctgttcccgccctcctctccg

SEQ ID NO: 581526 - DNA, 501 bp, Homo sapiens
  misc_feature: HIJSMM301AD90T.48.77.G11.1.454.light.4.raw
agtatacatacacgaccggtgctcgatttagctagtcactcaagggaaagggggtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaacgggacacgactggagattaaacgaactagtggctgcaccatctgtcttcattcc

SEQ ID NO: 581527 - DNA, 505 bp, Homo sapiens
  misc_feature: HIJSMM301BHOGS.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccaggaggggagtgaatggaggggtgcagagaactccatggctaccaggtcagcccaaggccaacccactgtcactctcgttcccgccctcctcta

SEQ ID NO: 581528 - DNA, 506 bp, Homo sapiens; identical to SEQ ID NO: 554070
  misc_feature: HIJSMM301D4FAG.15.5.A05.1.454.light.4.raw

SEQ ID NO: 581529 - DNA, 486 bp, Homo sapiens
  misc_feature: HIJSMM301BS4CE.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggctgccccccg

SEQ ID NO: 581530 - DNA, 514 bp, Homo sapiens
  misc_feature: HIJSMM301DQTFF.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctcctcgctacgtagac

SEQ ID NO: 581531 - DNA, 490 bp, Homo sapiens; identical to SEQ ID NO: 535234
  misc_feature: HIJSMM301DQ7IU.17.21.B10.1.454.light.4.raw

SEQ ID NO: 581532 - DNA, 502 bp, Homo sapiens
  misc_feature: HIJSMM301CI9HK.53.10.A10.1.454.light.4.raw
cgcgtatacacacgaccggtgctcgatttagcgtcgatctcagggggggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcgggggaccaaacgtgaccgtcctaggtcagcccaaggctcgccccctcggtccactctcgttcccaccct

SEQ ID NO: 581533 - DNA, 492 bp, Homo sapiens
  misc_feature: HIJSMM301C2PR1.48.79.H02.1.454.light.4.raw
agtatacatacacgaccggtgctcgatttagtgtcacacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgtcgtccaaggaccgaacggtaggaagtacaacgaactacgtggc

SEQ ID NO: 581534 - DNA, 503 bp, Homo sapiens; identical to SEQ ID NO: 541454
  misc_feature: HIJSMM301C7X50.9.12.B01.1.454.light.4.raw

SEQ ID NO: 581535 - DNA, 522 bp, Homo sapiens
  misc_feature: HIJSMM301BAAND.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccactgtcactctgttcccacccctcctccgtcgt

SEQ ID NO: 581536 - DNA, 495 bp, Homo sapiens; identical to SEQ ID NO: 539061
  misc_feature: HIJSMM301D8PY0.22.27.C05.1.454.light.4.raw

SEQ ID NO: 581537 - DNA, 488 bp, Homo sapiens
  misc_feature: HIJSMM301BSL2J.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggcgtaac

SEQ ID NO: 581538 - DNA, 500 bp, Homo sapiens
  misc_feature: HIJSMM301BWMAQ.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaacctcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaa

SEQ ID NO: 581539 - DNA, 447 bp, Homo sapiens; identical to SEQ ID NO: 535020
  misc_feature: HIJSMM301EIUGJ.18.9.A09.1.454.light.4.raw

SEQ ID NO: 581540 - DNA, 497 bp, Homo sapiens
  misc_feature: HIJSMM301BI435.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaaccttcggccaagggacacgactggagattaaaaggaactagtggctgcaccatctgtcttcatcttccccg

SEQ ID NO: 581541 - DNA, 502 bp, Homo sapiens
  misc_feature: HIJSMM301BAIEV.15.1.A01.1.454.light.4.raw
  modified_base (471)..(471): a, c, t, g, unknown or other
  modified_base (475)..(475): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctncgtnagcccaaggctgccccctccggtcact

SEQ ID NO: 581542 - DNA, 481 bp, Homo sapiens; identical to SEQ ID NO: 535993
  misc_feature: HIJSMM301CNG3G.21.25.C03.1.454.light.4.raw

SEQ ID NO: 581543 - DNA, 503 bp, Homo sapiens
  misc_feature: HIJSMM301B2WM1.4.71.G05.1.454.light.4.raw
  modified_base (490)..(490): a, c, t, g, unknown or other
agcactgtagcacgaccggtgctcgatttagtgtcgtcgcaagagagagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacaagtgataattctgggtgttcggcggagggaccaaaactgaccgtcctaggtcagccaaggctgcccccncggtcactctgtt

SEQ ID NO: 581544 - DNA, 503 bp, Homo sapiens; identical to SEQ ID NO: 540029
  misc_feature: HIJSMM301DHET9.7.71.G05.1.454.light.4.raw

SEQ ID NO: 581545 - DNA, 508 bp, Homo sapiens; identical to SEQ ID NO: 561027
  misc_feature: HIJSMM301DAQMS.47.85.H08.1.454.light.4.raw

SEQ ID NO: 581546 - DNA, 513 bp, Homo sapiens
  misc_feature: HIJSMM301BC77X.43.23.C01.1.454.light.4.raw
tgtgagtagtcacgaccggtgctcgatttagtacacgtgattagggattggggctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctcgttcccaccct

SEQ ID NO: 581547 - DNA, 500 bp, Homo sapiens
  misc_feature: HIJSMM301CSF1U.3.33.C11.1.454.light.4.raw
  modified_base (420)..(420): a, c, t, g, unknown or other
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtccgtgggcccagtctgccctgactcagcctccctccgcgtccgggtctcctggacagtcagtcaccatctcctgcactggaaccagcagtgacattggtgattataactatgtctcctggtaccagcagcacccagacaaagcccccaaactcatgatttatgaggtcacaaagcggccctcaggggtccctgatcgcttctctgcctccaagtctggcaacacggcctccctgaccgtctctgggctccagcctgaggatgaggctgattattactgcanctcatatgcaggcatcaacactgttttcggcggagggaccaagctgaccgtcctaggtcagcccaacggctgtccccccg

SEQ ID NO: 581548 - DNA, 523 bp, Homo sapiens
  misc_feature: HIJSMM301DK6GV.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccacggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaaccccactgtcactctcgttcccgccctcctccgtcg

SEQ ID NO: 581549 - DNA, 481 bp, Homo sapiens
  misc_feature: HIJSMM301DQ58B.40.59.F04.1.454.light.4.raw
tctagcgactcacgaccggtgctcgatttagtacacacacttagggattggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagcccaaggcg

SEQ ID NO: 581550 - DNA, 500 bp, Homo sapiens
  misc_feature: HIJSMM301DA7KA.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctcgccccctcggt

SEQ ID NO: 581551 - DNA, 486 bp, Homo sapiens; identical to SEQ ID NO: 537238
  misc_feature: HIJSMM301DR79I.19.71.G05.1.454.light.4.raw

SEQ ID NO: 581552 - DNA, 466 bp, Homo sapiens; identical to SEQ ID NO: 535366
  misc_feature: HIJSMM301DFX1C.13.4.A04.1.454.light.4.raw

SEQ ID NO: 581553 - DNA, 494 bp, Homo sapiens; identical to SEQ ID NO: 535276
  misc_feature: HIJSMM301CMQKW.16.6.A06.1.454.light.4.raw

SEQ ID NO: 581554 - DNA, 445 bp, Homo sapiens
  misc_feature: HIJSMM301BOCA2.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagccaaggccaaccctctgtcactctgttcccgccctcctccatactcgta

SEQ ID NO: 581555 - DNA, 468 bp, Homo sapiens
  misc_feature: HIJSMM301CVZGE.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccaaggtggaggatacaaacgaa

SEQ ID NO: 581556 - DNA, 448 bp, Homo sapiens; identical to SEQ ID NO: 557440
  misc_feature: HIJSMM301A6RCL.11.86.H09.1.454.light.4.raw

SEQ ID NO: 581557 - DNA, 454 bp, Homo sapiens; identical to SEQ ID NO: 534964
  misc_feature: HIJSMM301BUE0N.19.86.H09.1.454.light.4.raw

SEQ ID NO: 581558 - DNA, 494 bp, Homo sapiens
  misc_feature: HIJSMM301A1103.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgctagtttattactgtcagcagtatgatacctggcctccgtacacttttggccggggaccaagctggaatcaagcgaactgtggctgcaccatctgtcttcattcc

SEQ ID NO: 581559 - DNA, 499 bp, Homo sapiens
  misc_feature: HIJSMM301BJMR6.41.20.B09.1.454.light.4.raw
tctatactatcacgaccggtgctcgatttagtgtagtgtgaagggggagtcagacccagtcaggacacagcatggacatgagggtccccgctcagctcctggggctcctgctgctctggctcccaggtgccaaatgtgagatccagatgacccagtctccttccaccctgtctgcatctgttggagacacagtcaccatcacttgccgggccagtcagtatattaatgactggttggcctggtatcagcagaaaagagggagggccccaaagctcctgatttacaaggcaggctatttagaaaatggggccccatcaagatttagtggctttggaactgggacggagttcactctcaccatcaccggcctgcagcctgatgactttgcaacttattactgccagcaatatgacgtttacccgctcactttcggcggagggaccaaggtggaggatcaaaggaactgtggctgcaccatctgtcttcatcttcccgccta

SEQ ID NO: 581560 - DNA, 501 bp, Homo sapiens
  misc_feature: HIJSMM301BV0FM.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgctagtttattactgtcagcagcgtagcaactggcctcggttctacttttggccaggggaccaagctggagatcaaacgaactgtggctgcaccatctgtcttcatt

SEQ ID NO: 581561 - DNA, 493 bp, Homo sapiens
  misc_feature: HIJSMM301BE0PD.40.43.D10.1.454.light.4.raw
tctagcgactcacgaccggtgctcgatttagactagcagtaaggggactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcaccatctgtcttcatcttcccgcc

SEQ ID NO: 581562 - DNA, 499 bp, Homo sapiens
  misc_feature: HIJSMM301CVA5U.47.64.F09.1.454.light.4.raw
agctcacgtacacgaccggtgctcgatttagcgcgtatacaagggggagggaactggctcagttaggacccagagggaaccatggaagccccagctctagctttctcttcctcctgctactctggctcccagataccatcggagaagttgtgttgacacagtctccagccaccctgtctttgtctccaggggaaagagccaccctctcctgcagggccagtcagtaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcacgtttcggcggagggaccagggtggagatcaaacgaactgtggctgcaccatctgtcttcatt

SEQ ID NO: 581563 - DNA, 487 bp, Homo sapiens; identical to SEQ ID NO: 536536
  misc_feature: HIJSMM301A5QPH.26.45.E01.1.454.light.4.raw

SEQ ID NO: 581564 - DNA, 520 bp, Homo sapiens; identical to SEQ ID NO: 537173
  misc_feature: HIJSMM301CSH4U.27.23.C01.1.454.light.4.raw

SEQ ID NO: 581565 - DNA, 521 bp, Homo sapiens
  misc_feature: HIJSMM301DE0UQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 581566 - DNA, 525 bp, Homo sapiens
  misc_feature: HIJSMM301BEV8R.12.5.A05.1.454.light.4.raw
atacgacgtacacgaccggtgctcgatttagatagatagacaggggggggtctcaggaggcagcgctctcgggacgtctccaccatggcctgggctctgctattcctcaccctcctcactcagggcacagggtcctgggcccactctgccctgactcagcctgcctccgtgtctgggtctcctggacagtcgatcaccatctcctgcactgcaaccagcagtgacgttaatgataataactatttctcctggtaccagcaacacccaggcaaagcccccaaactcctcatttatggtgtcgggaatcggccctcaggggtttctaatcgcttctctggctccaagtctggcaaaacggcctccctgaccatctctggactccagcctgaggacgaggccgattactactgcattgcacagacaaggagtcccacttgggtgttcggcggagggaccaaactgaccgtcctaggtcagcccaaggctgccccctcggtcactctcgttccaccctcctctacgtcg

SEQ ID NO: 581567 - DNA, 454 bp, Homo sapiens; identical to SEQ ID NO: 542360
  misc_feature: HIJSMM301EBPDJ.19.86.H09.1.454.light.4.raw

SEQ ID NO: 581568 - DNA, 500 bp, Homo sapiens; identical to SEQ ID NO: 551605
  misc_feature: HIJSMM301EK20K.2.34.D01.1.454.light.4.raw

SEQ ID NO: 581569 - DNA, 495 bp, Homo sapiens; identical to SEQ ID NO: 538920
  misc_feature: HIJSMM301CRY23.47.64.F09.1.454.light.4.raw

SEQ ID NO: 581570 - DNA, 498 bp, Homo sapiens; identical to SEQ ID NO: 553275
  misc_feature: HIJSMM301DLU0U.48.23.C01.1.454.light.4.raw

SEQ ID NO: 581571 - DNA, 505 bp, Homo sapiens; identical to SEQ ID NO: 535503
  misc_feature: HIJSMM301DJ6Y4.8.28.C06.1.454.light.4.raw

SEQ ID NO: 581572 - DNA, 493 bp, Homo sapiens
  misc_feature: HIJSMM301CV585.51.28.C06.1.454.light.4.raw
cgatcgtatacacgaccggtgctcgatttagagctcacgtattgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctggtcagcccaaggccaacccactgtcact

SEQ ID NO: 581573 - DNA, 494 bp, Homo sapiens
  misc_feature: HIJSMM301AUVMC.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataaatggttcctgctcactttcggcgggggaccgaaggtggagatcaaacgaactgtggctgcaccatctgtt

SEQ ID NO: 581574 - DNA, 467 bp, Homo sapiens
  misc_feature: HIJSMM301A3GJX.51.9.A09.1.454.light.4.raw
cgatcgtatacacgaccggtgctcgatttagcgagacgcgcagggactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccaaactgaccgtcctaggtcagcccaaggctgccccctcggtcactctgttcccaccctcctctcgtagcact

SEQ ID NO: 581575 - DNA, 494 bp, Homo sapiens
  misc_feature: HIJSMM301CUN8H.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattactgcatgcaagctctacaaaactccctcaacgttcggcggagggaccaaggtggagatcaaaacgaactgtggctgcaccatctgtcttca

SEQ ID NO: 581576 - DNA, 500 bp, Homo sapiens
  misc_feature: HIJSMM301A5PFR.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccaagactgaccgtcctaggtcagcccaaggctgtccccccg

SEQ ID NO: 581577 - DNA, 480 bp, Homo sapiens; identical to SEQ ID NO: 559070
  misc_feature: HIJSMM301C6VHC.21.25.C03.1.454.light.4.raw

SEQ ID NO: 581578 - DNA, 516 bp, Homo sapiens
  misc_feature: HIJSMM301B76HD.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcaggtgggtctgggacagacttcactctcaccatcatcagcctggagcctgaagatgttgctagtttattactgtcaacatcgtaccgagtcggccgtccgggggccctactttccggcccgtgggaccaaaggtggatatacaaacgaactgtggctgcaccatctgttctt

SEQ ID NO: 581579 - DNA, 507 bp, Homo sapiens
  misc_feature: HIJSMM301E2AAW.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcaactttcgatgtcctattcggcggagggaccaagctgaccgtcctgggtcagccaaggctgcccctccggtccactctgttcccaccctcctcctacgtcgtat

SEQ ID NO: 581580 - DNA, 490 bp, Homo sapiens; identical to SEQ ID NO: 541974
  misc_feature: HIJSMM301DNZS9.22.65.F10.1.454.light.4.raw

SEQ ID NO: 581581 - DNA, 497 bp, Homo sapiens; identical to SEQ ID NO: 536371
  misc_feature: HIJSMM301EHEKC.16.78.H01.1.454.light.4.raw

SEQ ID NO: 581582 - DNA, 484 bp, Homo sapiens
  misc_feature: HIJSMM301ANHP1.16.81.H04.1.454.light.4.raw
tgtactactccacgaccggtgctcgatttagtagtgtagattcgcgggggactcagactcagtcaggacacagcatggacatgagggtccccgctcagctcctggggctcctgctgctctggctcccgggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgtctt

SEQ ID NO: 581583 - DNA, 499 bp, Homo sapiens
  misc_feature: HIJSMM301DUXGE.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcaccctttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcatcggcggagggaccgaaggtggaggatcaaacgaactacgtggg

SEQ ID NO: 581584 - DNA, 508 bp, Homo sapiens; identical to SEQ ID NO: 546914
  misc_feature: HIJSMM301DOKDF.17.41.D08.1.454.light.4.raw

SEQ ID NO: 581585 - DNA, 487 bp, Homo sapiens; identical to SEQ ID NO: 536206
  misc_feature: HIJSMM301A1GW5.47.38.D05.1.454.light.4.raw

SEQ ID NO: 581586 - DNA, 484 bp, Homo sapiens; identical to SEQ ID NO: 535441
  misc_feature: HIJSMM301AO2GS.26.60.F05.1.454.light.4.raw

SEQ ID NO: 581587 - DNA, 505 bp, Homo sapiens; identical to SEQ ID NO: 535503
  misc_feature: HIJSMM301DW9YB.8.28.C06.1.454.light.4.raw

SEQ ID NO: 581588 - DNA, 505 bp, Homo sapiens; identical to SEQ ID NO: 535503
  misc_feature: HIJSMM301CIB0Z.8.28.C06.1.454.light.4.raw

SEQ ID NO: 581589 - DNA, 512 bp, Homo sapiens
  misc_feature: HIJSMM301BC8HG.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccacactgaccgtcctaggtcagccaaggctcgccccctcggtcactctgtt

SEQ ID NO: 581590 - DNA, 484 bp, Homo sapiens
  misc_feature: HIJSMM301BZ8RO.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccaagctggagatcaaacgaactgtggctgcacat

SEQ ID NO: 581591 - DNA, 502 bp, Homo sapiens; identical to SEQ ID NO: 543172
  misc_feature: HIJSMM301BU65R.18.59.F04.1.454.light.4.raw

SEQ ID NO: 581592 - DNA, 491 bp, Homo sapiens
  misc_feature: HIJSMM301CK0BJ.40.81.H04.1.454.light.4.raw
tctagcgactcacgaccggtgctcgatttagtagtgtagattcgcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaactctacaaactgtgtggacggtcggccaagggaccaaggtggaaatcaagcgaactgtggctgcacc

SEQ ID NO: 581593 - DNA, 517 bp, Homo sapiens
  misc_feature: HIJSMM301ALBVS.40.74.G08.1.454.light.4.raw
tctagcgactcacgaccggtgctcgatttagtagctctatcaggggagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccct

SEQ ID NO: 581594 - DNA, 511 bp, Homo sapiens; identical to SEQ ID NO: 539247
  misc_feature: HIJSMM301D9QRX.15.34.D01.1.454.light.4.raw

SEQ ID NO: 581595 - DNA, 495 bp, Homo sapiens
  misc_feature: HIJSMM301BQWN7.48.22.B11.1.454.light.4.raw
agtatacatacacgaccggtgctcgatttagacgacagctcaggggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccg

SEQ ID NO: 581596 - DNA, 486 bp, Homo sapiens
  misc_feature: HIJSMM301DEI2Q.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatactgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaa

SEQ ID NO: 581597 - DNA, 510 bp, Homo sapiens
  misc_feature: HIJSMM301B4N9L.14.85.H08.1.454.light.4.raw
cgtctagtaccacgaccggtgctcgatttagtatcactcagtcgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcactctcg

SEQ ID NO: 581598 - DNA, 475 bp, Homo sapiens
  misc_feature: HIJSMM301D7U7H.52.19.B08.1.454.light.4.raw
cgcagtacgacacgaccggtgctcgatttagtgagtcagtaaggggggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccaaggtggagatcaagcgaactgtggctgcacc

SEQ ID NO: 581599 - DNA, 518 bp, Homo sapiens
  misc_feature: HIJSMM301EX7PE.49.35.D02.1.454.light.4.raw
agtcgagagacacgaccggtgctcgatttagcacacgatagttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcgggaccaaactgaccgtcctacgtcagcccaaggctgccccctcggtcactctgttcccta

SEQ ID NO: 581600 - DNA, 486 bp, Homo sapiens; identical to SEQ ID NO: 536553
  misc_feature: HIJSMM301DLGVC.17.34.D01.1.454.light.4.raw

SEQ ID NO: 581601 - DNA, 520 bp, Homo sapiens
  misc_feature: HIJSMM301DLCJN.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtactctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcaccg

SEQ ID NO: 581602 - DNA, 518 bp, Homo sapiens
  misc_feature: HIJSMM301A2SDH.3.87.H10.1.454.light.4.raw
agacgcactccacgaccggtgctcgatttagcagtactgcgttgggtttggggggggtcgtcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatacacaaccggcaccactgtcgtggttttcggtggagggaccaagctgaccgtcctaggtcagcccaaggctgccccctcggtcact

SEQ ID NO: 581603 - DNA, 503 bp, Homo sapiens; identical to SEQ ID NO: 539069
  misc_feature: HIJSMM301BW1NY.48.26.C04.1.454.light.4.raw

SEQ ID NO: 581604 - DNA, 523 bp, Homo sapiens
  misc_feature: HIJSMM301CO4UY.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaatttttgacctagtctcctggtaccaacaataccccggcaaagtccccaagttaatcatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagccaaggctgccccctcggtcactctgttctccg

SEQ ID NO: 581605 - DNA, 513 bp, Homo sapiens; identical to SEQ ID NO: 541387
  misc_feature: HIJSMM301CIL0O.17.33.C11.1.454.light.4.raw

SEQ ID NO: 581606 - DNA, 480 bp, Homo sapiens
  misc_feature: HIJSMM301BE53Z.12.10.A10.1.454.light.4.raw
atacgacgtacacgaccggtgctcgatttagcgtcgatctcagggggcaggagtcagtcccagtcaggacacagcatggacatgagggtccccgctcagctcctggggctcctgctgctctggctcccaggtgccagatgtgacatccagttgacccagtctccatccttcctgtctgcatctataggagacagagtcaccatcacttgccgggccagtcaggacattagcaattatttaggctggtatcagcagaagccagggaagcccctaacgtcctgatctatggtgcatccactttgcatagtggggtcccatcaaggttcagcggcagtggatctgggacagaattcactctcacaatcaccagcctgcagcctgaagattttgcaacttattactgtcaacaggtttatatttaccctcgtattttcggcccttgggaccacagtagatatcaaacgaactagtggctgcacc

SEQ ID NO: 581607 - DNA, 520 bp, Homo sapiens
  misc_feature: HIJSMM301AP6FD.48.45.E01.1.454.light.4.raw
agtatacatacacgaccggtgctcgatttagtgagtcagtaagggaaaggggtggtctgggcctaaggaagcagcactggtggtgcctcagccatggcctggaccgttctcctcctcggcctcctctctcactgcacagggtcggtgacttcctatgtgctgactcagccaccctcggtgtcagtggccccgggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgtcccctcggtcactctgttcccaccctcct

SEQ ID NO: 581608 - DNA, 489 bp, Homo sapiens
  misc_feature: HIJSMM301B86M2.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtccctcaaggttcagcggcagtggatctgggacagatttcactctcgccatcagcagcctgcagactgaagattttgcaacttattttgtcaacaggctaacactttccccctcactttcggcggagggaccaaggtggagatcaagcgaactgtggctgcaccatctgtctt

SEQ ID NO: 581609 - DNA, 505 bp, Homo sapiens
  misc_feature: HIJSMM301D6MJ5.8.24.C02.1.454.light.4.raw
ctcgcgtgtccacgaccggtgctcgatttagtacagatcgttagggaaagggggggtcgtcaggaggcagcgctctcgggacgtctccaccatggcctgggctctgttattcctcaccctcctcactcagggcacagggtccgagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggagggaccaagttgaccgtcctaagtcagcccaaggctgccccctc

SEQ ID NO: 581610 - DNA, 489 bp, Homo sapiens; identical to SEQ ID NO: 535139
  misc_feature: HIJSMM301AQAZU.14.55.E11.1.454.light.4.raw

SEQ ID NO: 581611 - DNA, 383 bp, Homo sapiens; identical to SEQ ID NO: 447524
  misc_feature: HIJSMM301CZWIQ.41.26.C04.1.454.light.4.raw

SEQ ID NO: 581612 - DNA, 490 bp, Homo sapiens
  misc_feature: HIJSMM301A9C08.5.40.D07.1.454.light.4.raw
atcagacacgcacgaccggtgctcgatttagtgatagagcgtaacaacagagggggaggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtggatctgggacagatttcactctcaccatcagcagcctgcagcctgaagattttgcaacttactattgtcaacaggctaacagtttccctccgaccttcggccaagggacacgactggagattaaacgaactagtggctgcaccact

SEQ ID NO: 581613 - DNA, 506 bp, Homo sapiens; identical to SEQ ID NO: 534969
  misc_feature: HIJSMM301DRJOU.18.37.D04.1.454.light.4.raw

SEQ ID NO: 581614 - DNA, 496 bp, Homo sapiens
  misc_feature: HIJSMM301B93TJ.12.37.D04.1.454.light.4.raw
  modified_base (366)..(366): a, c, t, g, unknown or other
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttacccncaccatcagcagcctgcagcctgaagatcttgcaacatattactgtcaacagtataataatctcccgtacacttttggccaggggaccaagctggagatcaaacgaactgtgctgcaccatctgtcttca

SEQ ID NO: 581615 - DNA, 499 bp, Homo sapiens; identical to SEQ ID NO: 543600
  misc_feature: HIJSMM301D1FIL.14.23.C01.1.454.light.4.raw

SEQ ID NO: 581616 - DNA, 487 bp, Homo sapiens
  misc_feature: HIJSMM301CZ4UI.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcacgtgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttggtgttcggcggaggaccaagctgaccgtccgtaggtcacg

SEQ ID NO: 581617 - DNA, 442 bp, Homo sapiens
  misc_feature: HIJSMM301AY3Q9.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccgccctcctcatagtattaga

SEQ ID NO: 581618 - DNA, 498 bp, Homo sapiens
  misc_feature: HIJSMM301CW0LD.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggcctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcacgtcctaggtcagccaaggccaacccactg

SEQ ID NO: 581619 - DNA, 444 bp, Homo sapiens; identical to SEQ ID NO: 535027
  misc_feature: HIJSMM301EKP2J.8.73.G07.1.454.light.4.raw

SEQ ID NO: 581620 - DNA, 509 bp, Homo sapiens; identical to SEQ ID NO: 539359
  misc_feature: HIJSMM301CQWM0.47.85.H08.1.454.light.4.raw

SEQ ID NO: 581621 - DNA, 487 bp, Homo sapiens; identical to SEQ ID NO: 539157
  misc_feature: HIJSMM301A7SIC.26.37.D04.1.454.light.4.raw

SEQ ID NO: 581622 - DNA, 510 bp, Homo sapiens
  misc_feature: HIJSMM301ER1WL.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatggaggccgactattactgtcaggtgtgggatagtagtggtgatcatccatacgtcttcggaactgggaccaaggtctcgtcctacgtcagcccaaggccaacccactcgtcactctgttcccta

SEQ ID NO: 581623 - DNA, 496 bp, Homo sapiens; identical to SEQ ID NO: 536248
  misc_feature: HIJSMM301C8G77.22.27.C05.1.454.light.4.raw

SEQ ID NO: 581624 - DNA, 503 bp, Homo sapiens; identical to SEQ ID NO: 538884
  misc_feature: HIJSMM301D8CS1.27.78.H01.1.454.light.4.raw

SEQ ID NO: 581625 - DNA, 475 bp, Homo sapiens; identical to SEQ ID NO: 544617
  misc_feature: HIJSMM301DMEJG.13.76.G10.1.454.light.4.raw

SEQ ID NO: 581626 - DNA, 484 bp, Homo sapiens
  misc_feature: HIJSMM301EGGH7.48.41.D08.1.454.light.4.raw
agtatacatacacgaccggtgctcgatttagtcacgcgagaaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggtagggacccaagctgactgtccctaggt

SEQ ID NO: 581627 - DNA, 489 bp, Homo sapiens; identical to SEQ ID NO: 544329
  misc_feature: HIJSMM301BBZ9G.11.28.C06.1.454.light.4.raw

SEQ ID NO: 581628 - DNA, 492 bp, Homo sapiens
  misc_feature: HIJSMM301EDUHL.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcttacacttttggccaggggaccaagctggagatcaaacgaactgtgg

SEQ ID NO: 581629 - DNA, 484 bp, Homo sapiens
  misc_feature: HIJSMM301DFU40.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgaactgtggctgcacca

SEQ ID NO: 581630 - DNA, 487 bp, Homo sapiens; identical to SEQ ID NO: 536206
  misc_feature: HIJSMM301AUPP8.47.38.D05.1.454.light.4.raw

SEQ ID NO: 581631 - DNA, 486 bp, Homo sapiens; identical to SEQ ID NO: 535043
  misc_feature: HIJSMM301EMXOZ.46.35.D02.1.454.light.4.raw

SEQ ID NO: 581632 - DNA, 503 bp, Homo sapiens
  misc_feature: HIJSMM301CYG19.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacgttcggccctgggaccaaagtggatatcaacgaactgtggctgcaccatctgtt

SEQ ID NO: 581633 - DNA, 482 bp, Homo sapiens
  misc_feature: HIJSMM301CHK6L.48.85.H08.1.454.light.4.raw
agtatacatacacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacaatcacctgcactgggaacaacaataatgtcgccaaccaaggagcagcttggctgcagcagcaccagggccaccctcccaaagtcgtatccgacagggataacaatcggcccttagggatctcagagagaatatctgcatccaggtcaggaaacacagcctcctgaccattactggactccaacctgaggacgaggctgactattattgctcagcatgggacaccagcctcaatgccgcggtattcggcgcagggaccaagctgaccgtcctaggtcacg

SEQ ID NO: 581634 - DNA, 512 bp, Homo sapiens
  misc_feature: HIJSMM301DI0KR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagttttattactgtcaacagtttttctcggggcttcggccgaacgggaccaagggtggaaagtacaaaacgaactagtggctgcaccatctgtcttcattcttccccg

SEQ ID NO: 581635 - DNA, 487 bp, Homo sapiens; identical to SEQ ID NO: 536206
  misc_feature: HIJSMM301EU6FP.47.38.D05.1.454.light.4.raw

SEQ ID NO: 581636 - DNA, 504 bp, Homo sapiens; identical to SEQ ID NO: 547861
  misc_feature: HIJSMM301BFT08.5.68.G02.1.454.light.4.raw

SEQ ID NO: 581637 - DNA, 499 bp, Homo sapiens; identical to SEQ ID NO: 537739
  misc_feature: HIJSMM301D9HUB.12.86.H09.1.454.light.4.raw

SEQ ID NO: 581638 - DNA, 504 bp, Homo sapiens; identical to SEQ ID NO: 535561
  misc_feature: HIJSMM301E2QBV.4.57.F02.1.454.light.4.raw

SEQ ID NO: 581639 - DNA, 495 bp, Homo sapiens; identical to SEQ ID NO: 535007
  misc_feature: HIJSMM301CCJJD.22.5.A05.1.454.light.4.raw

SEQ ID NO: 581640 - DNA, 502 bp, Homo sapiens; identical to SEQ ID NO: 565460
  misc_feature: HIJSMM301EG86T.12.48.E04.1.454.light.4.raw

SEQ ID NO: 581641 - DNA, 522 bp, Homo sapiens
  misc_feature: HIJSMM301CDOAG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtgttcggcggagggaccaggctgaccgtcctaggtcagcccaaggctgccccctcggtcactctgttcccgccct

SEQ ID NO: 581642 - DNA, 494 bp, Homo sapiens; identical to SEQ ID NO: 562050
  misc_feature: HIJSMM301C613Z.5.64.F09.1.454.light.4.raw

SEQ ID NO: 581643 - DNA, 499 bp, Homo sapiens; identical to SEQ ID NO: 536875
  misc_feature: HIJSMM301AM3Y7.51.26.C04.1.454.light.4.raw

SEQ ID NO: 581644 - DNA, 496 bp, Homo sapiens
  misc_feature: HIJSMM301EP1TI.49.14.B03.1.454.light.4.raw
agtcgagagacacgaccggtgctcgatttagtgtgagtagttccgcgggcacgaccggtgctcgatttagtgtgagtagttccgcgggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcgtcggagggaccacggtcggagatac

SEQ ID NO: 581645 - DNA, 516 bp, Homo sapiens
  misc_feature: HIJSMM301CVVJU.40.87.H10.1.454.light.4.raw
tctagcgactcacgaccggtgctcgatttagcagtactgcgttgggtttgggggtagagaagacaggattcaggacaatctccagcatggccggcttccctctcctcctcaccctcctcactcactgtgcagggtcctgggcccagtctgtgctgactcagccaccctcagcgtctgggaccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggaggaccaagctgaccgtctaggtcagcccaaggctgccccctcggtcactctgttcccaccctcct

SEQ ID NO: 581646 - DNA, 489 bp, Homo sapiens; identical to SEQ ID NO: 535139
  misc_feature: HIJSMM301EBW95.14.55.E11.1.454.light.4.raw

SEQ ID NO: 581647 - DNA, 501 bp, Homo sapiens; identical to SEQ ID NO: 581041
  misc_feature: HIJSMM301CDZTL.43.34.D01.1.454.light.4.raw

SEQ ID NO: 581648 - DNA, 487 bp, Homo sapiens; identical to SEQ ID NO: 547557
  misc_feature: HIJSMM301AIMTF.7.75.G09.1.454.light.4.raw

SEQ ID NO: 581649 - DNA, 502 bp, Homo sapiens
  misc_feature: HIJSMM301CQZGL.48.28.C06.1.454.light.4.raw
agtatacatacacgaccggtgctcgatttagagctcacgtattgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatggggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctgccccctggt

SEQ ID NO: 581650 - DNA, 518 bp, Homo sapiens; identical to SEQ ID NO: 563314
  misc_feature: HIJSMM301BXKS6.14.70.G04.1.454.light.4.raw

SEQ ID NO: 581651 - DNA, 448 bp, Homo sapiens
  misc_feature: HIJSMM301CR6UW.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccgccctcctccactactcta

SEQ ID NO: 581652 - DNA, 517 bp, Homo sapiens
  misc_feature: HIJSMM301C56RE.40.74.G08.1.454.light.4.raw
tctagcgactcacgaccggtgctcgatttagtagctctatcaggggggggaagctcagcttcagctgtgggtagagaagacaggactcaggacaatctccagcatggccagcttccctctcctcctcaccctcctcactcactgtgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactggaccgtcctaggtcagcccaaggctgccccctcggt

SEQ ID NO: 581653 - DNA, 485 bp, Homo sapiens; identical to SEQ ID NO: 535606
  misc_feature: HIJSMM301C3A7I.47.46.E02.1.454.light.4.raw

SEQ ID NO: 581654 - DNA, 496 bp, Homo sapiens; identical to SEQ ID NO: 559735
  misc_feature: HIJSMM301EQWMC.13.38.D05.1.454.light.4.raw

SEQ ID NO: 581655 - DNA, 501 bp, Homo sapiens
  misc_feature: HIJSMM301CJK27.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccgaaagtggaggatcaaacgaaaccgtagtggctgcaccactctgtctt

SEQ ID NO: 581656 - DNA, 494 bp, Homo sapiens
  misc_feature: HIJSMM301B5DLJ.52.50.E06.1.454.light.4.raw
cgcagtacgacacgaccggtgctcgatttagatctactgacaacacacaagggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtgatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctggaccgtcctaggtcagcccaaggctgccccctc

SEQ ID NO: 581657 - DNA, 506 bp, Homo sapiens
  misc_feature: HIJSMM301CIC1Q.49.31.C09.1.454.light.4.raw
agtcgagagacacgaccggtgctcgatttagacgtctcatcaaggaaggaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcactcaccatctcctgcactggtggttataactctgtctcctggtaccaacagcacccaggcaaagcccccaaactcatgatttatgaggtcaataggcggccctcaggggtccctgatcgcttctctggctccaagtctggcaccacggcctccctgaccgtctctgggctccaggcagaggatgaggctgattattactgcagctcatctgcaggcattaacaattttaatgtggtattcggcggagggaccaagctgaccgtcctaggtcagcccaaggctgccccctcggtcactcttcg

SEQ ID NO: 581658 - DNA, 494 bp, Homo sapiens
  misc_feature: HIJSMM301BJ208.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcaccaaggtcaccgtcctggtcagcccaaggccaaccccactgtcact

SEQ ID NO: 581659 - DNA, 503 bp, Homo sapiens
  misc_feature: HIJSMM301CQNDZ.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccgaaggtaggaaatacaaacgaactagtggctgcaccatctgtcttcatcttccccg

SEQ ID NO: 581660 - DNA, 495 bp, Homo sapiens
  misc_feature: HIJSMM301DJCS3.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagtcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtctt

SEQ ID NO: 581661 - DNA, 486 bp, Homo sapiens; identical to SEQ ID NO: 535043
  misc_feature: HIJSMM301BTZFH.46.35.D02.1.454.light.4.raw

SEQ ID NO: 581662 - DNA, 511 bp, Homo sapiens
  misc_feature: HIJSMM301EVJ0V.8.34.D01.1.454.light.4.raw
  modified_base (205)..(205): a, c, t, g, unknown or other
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaanagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgctagtttattactgtcaacatcgtaccgagtggcctccgggggccacgtttcggccctcgggaccgaagtggatatcaaacgaactgtggctgcaccatctgtcttcta

SEQ ID NO: 581663 - DNA, 494 bp, Homo sapiens; identical to SEQ ID NO: 534992
  misc_feature: HIJSMM301A27BM.9.1.A01.1.454.light.4.raw

SEQ ID NO: 581664 - DNA, 495 bp, Homo sapiens
  misc_feature: HIJSMM301AS1EC.8.10.A10.1.454.light.4.raw
ctcgcgtgtccacgaccggtgctcgatttagcgtcgatctcagggggaggaactgctcagttaggacccagagggaaccatggaagccccagctcagcttctcttcctcctgctactctggctcccagataccaccggagaaattgtgttgacacagtctccagccaccctgtctttgcctccaggggaaagagccaccctctcctgcagggccagtcttagtgttagcaacttagcctggtaccaacagaaacctggccaggctcccaggctcctcatctctgatacatccaacagggccactggcatcccagccaggttcagtggcagtgggtctgggacagacttcactctcaccatcagcagcctagagcctgaagattttgcactttattactgtcagcagcgtagtaactggcctttcactttcggccctgggaccaagtggatatcaacgaactgtggctgcaccatctgtcttcatcttcccgccat

SEQ ID NO: 581665 - DNA, 491 bp, Homo sapiens
  misc_feature: HIJSMM301ADDEG.41.73.G07.1.454.light.4.raw
tctatactatcacgaccggtgctcgatttagctctacgctcagggcacgaccggtgctcgatttagtgagtcagtaagggggctggggtctcaggaggcagcgctctcgggacgtctccaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggccccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcggggggaccg

SEQ ID NO: 581666 - DNA, 434 bp, Homo sapiens; identical to SEQ ID NO: 535153
  misc_feature: HIJSMM301DBINC.18.5.A05.1.454.light.4.raw

SEQ ID NO: 581667 - DNA, 492 bp, Homo sapiens
  misc_feature: HIJSMM301CXYLA.51.39.D06.1.454.light.4.raw
cgatcgtatacacgaccggtgctcgatttagtgacatctcgcagttctttggggagagaggcctggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtctacccg

SEQ ID NO: 581668 - DNA, 441 bp, Homo sapiens; identical to SEQ ID NO: 534971
  misc_feature: HIJSMM301AQB8P.11.3.A03.1.454.light.4.raw

SEQ ID NO: 581669 - DNA, 496 bp, Homo sapiens; identical to SEQ ID NO: 536248
  misc_feature: HIJSMM301CIY9I.22.27.C05.1.454.light.4.raw

SEQ ID NO: 581670 - DNA, 444 bp, Homo sapiens; identical to SEQ ID NO: 561524
  misc_feature: HIJSMM301DWKCN.4.39.D06.1.454.light.4.raw

SEQ ID NO: 581671 - DNA, 482 bp, Homo sapiens; identical to SEQ ID NO: 535796
  misc_feature: HIJSMM301CY8AF.51.64.F09.1.454.light.4.raw

SEQ ID NO: 581672 - DNA, 500 bp, Homo sapiens; identical to SEQ ID NO: 544063
  misc_feature: HIJSMM301EA92X.12.18.B07.1.454.light.4.raw

SEQ ID NO: 581673 - DNA, 501 bp, Homo sapiens; identical to SEQ ID NO: 536142
  misc_feature: HIJSMM301CD1WI.15.1.A01.1.454.light.4.raw

SEQ ID NO: 581674 - DNA, 495 bp, Homo sapiens; identical to SEQ ID NO: 535596
  misc_feature: HIJSMM301A212M.10.79.H02.1.454.light.4.raw

SEQ ID NO: 581675 - DNA, 502 bp, Homo sapiens; identical to SEQ ID NO: 543913
  misc_feature: HIJSMM301BI2PU.18.26.C04.1.454.light.4.raw

SEQ ID NO: 581676 - DNA, 485 bp, Homo sapiens
  misc_feature: HIJSMM301D3DL9.5.23.C01.1.454.light.4.raw
atcagacacgcacgaccggtgctcgatttagtacacgtgattagggattggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaacgaactgtggctgcacat

SEQ ID NO: 581677 - DNA, 494 bp, Homo sapiens; identical to SEQ ID NO: 534994
  misc_feature: HIJSMM301EUY1B.27.78.H01.1.454.light.4.raw

SEQ ID NO: 581678 - DNA, 475 bp, Homo sapiens
  misc_feature: HIJSMM301C0EHP.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctcgttcccaccctcctcgctacgtaga

SEQ ID NO: 581679 - DNA, 486 bp, Homo sapiens; identical to SEQ ID NO: 535043
  misc_feature: HIJSMM301CKG1J.46.35.D02.1.454.light.4.raw

SEQ ID NO: 581680 - DNA, 520 bp, Homo sapiens; identical to SEQ ID NO: 537173
  misc_feature: HIJSMM301DRDDO.27.23.C01.1.454.light.4.raw

SEQ ID NO: 581681 - DNA, 497 bp, Homo sapiens
  misc_feature: HIJSMM301DBMSL.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccagggaccaaggtggaaatcaaacgaactgtggctgcacc

SEQ ID NO: 581682 - DNA, 494 bp, Homo sapiens; identical to SEQ ID NO: 534994
  misc_feature: HIJSMM301EDXED.27.78.H01.1.454.light.4.raw

SEQ ID NO: 581683 - DNA, 510 bp, Homo sapiens
  misc_feature: HIJSMM301CC5KS.48.87.H10.1.454.light.4.raw
agtatacatacacgaccggtgctcgatttagcagtactgcgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaaacgaactgtggctgcaccatctgtcttcta

SEQ ID NO: 581684 - DNA, 492 bp, Homo sapiens; identical to SEQ ID NO: 538317
  misc_feature: HIJSMM301DRIHV.10.17.B06.1.454.light.4.raw

SEQ ID NO: 581685 - DNA, 487 bp, Homo sapiens
  misc_feature: HIJSMM301ARIDY.52.81.H04.1.454.light.4.raw
cgcagtacgacacgaccggtgctcgatttagtagtgtagattcgcggggctgcctgggcctcaggaagcagcatcggaggtgcctcagccatggcatggatccctctcttcctcggcgtccttgcttactgcacaggatccgtggcctcctatgagttgactcagccaccctcagtgtccgtgtccccaggacagacagccagcatcacctgctctggagataaattgggggataaatatgtttcctggtatcagcagaagccaggccagtcccctgcgttggtcatctatcaagataccaagaggcgctcagggatccctgagcgattctctggctccaactctggggacacagccactctgaccatcagcgggacccagactctggatgaggctgactattactgtcaggcgtgggacagcagcacgggggtgttcggcggagggaccaagctgaccgtcctaggtcagcccaaggctgcccccg

SEQ ID NO: 581686 - DNA, 516 bp, Homo sapiens; identical to SEQ ID NO: 580050
  misc_feature: HIJSMM301AVUDQ.41.35.D02.1.454.light.4.raw

SEQ ID NO: 581687 - DNA, 487 bp, Homo sapiens
  misc_feature: HIJSMM301D9DQ0.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaaacagtaatacttatctttatgtcttcggatctgggaccagggtcaccgtcctaggtcagcccaaggccaaa

SEQ ID NO: 581688 - DNA, 509 bp, Homo sapiens
  misc_feature: HIJSMM301ASYNO.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctcgggaccaaagtggatatcaaacgaactagtggctgcaccatctgtcttcta

SEQ ID NO: 581689 - DNA, 447 bp, Homo sapiens; identical to SEQ ID NO: 535020
  misc_feature: HIJSMM301DV8RH.18.9.A09.1.454.light.4.raw

SEQ ID NO: 581690 - DNA, 463 bp, Homo sapiens; identical to SEQ ID NO: 535062
  misc_feature: HIJSMM301A47ML.11.73.G07.1.454.light.4.raw

SEQ ID NO: 581691 - DNA, 515 bp, Homo sapiens
  misc_feature: HIJSMM301AFZDX.51.15.B04.1.454.light.4.raw
cgatcgtatacacgaccggtgctcgatttagacagtatatatccgcggggactgatcaggacttctcagttcatcttctcaccatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccgaacgggaccgaacggtgggaaagtacaaaccgaaactacgtggctgcaccactctgtt

SEQ ID NO: 581692 - DNA, 497 bp, Homo sapiens; identical to SEQ ID NO: 536371
  misc_feature: HIJSMM301BK5LU.16.78.H01.1.454.light.4.raw

SEQ ID NO: 581693 - DNA, 485 bp, Homo sapiens; identical to SEQ ID NO: 541838
  misc_feature: HIJSMM301C52KL.22.6.A06.1.454.light.4.raw

SEQ ID NO: 581694 - DNA, 485 bp, Homo sapiens; identical to SEQ ID NO: 539315
  misc_feature: HIJSMM301CFN5I.3.88.H11.1.454.light.4.raw

SEQ ID NO: 581695 - DNA, 497 bp, Homo sapiens
  misc_feature: HIJSMM301CQPBY.3.35.D02.1.454.light.4.raw
agacgcactccacgaccggtgctcgatttagcacacgatagttgggtttggggactgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttctgcatgcaagctacacactggccgtacacttttggccaggggaccaagctggagatcaaacgaactgtggctgca

SEQ ID NO: 581696 - DNA, 493 bp, Homo sapiens; identical to SEQ ID NO: 535084
  misc_feature: HIJSMM301EUURX.47.64.F09.1.454.light.4.raw

SEQ ID NO: 581697 - DNA, 511 bp, Homo sapiens; identical to SEQ ID NO: 537464
  misc_feature: HIJSMM301CIV4E.7.34.D01.1.454.light.4.raw

SEQ ID NO: 581698 - DNA, 444 bp, Homo sapiens; identical to SEQ ID NO: 535192
  misc_feature: HIJSMM301AJVT9.5.9.A09.1.454.light.4.raw

SEQ ID NO: 581699 - DNA, 495 bp, Homo sapiens; identical to SEQ ID NO: 546624
  misc_feature: HIJSMM301DRXYL.52.38.D05.1.454.light.4.raw

SEQ ID NO: 581700 - DNA, 504 bp, Homo sapiens
  misc_feature: HIJSMM301D5P86.48.36.D03.1.454.light.4.raw
agtatacatacacgaccggtgctcgatttagctgcgtcacgatctctcttggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcggtcaccatcgcctgcactggaaccagcagtgatattggtgcttacaactttgtctcctggtaccaacatcacccaggcaaagtccccaaggtcgttatttatgatgtcactaagcggccctcggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaacccactgtcactt

SEQ ID NO: 581701 - DNA, 505 bp, Homo sapiens; identical to SEQ ID NO: 547587
  misc_feature: HIJSMM301D2UZ3.12.53.E09.1.454.light.4.raw

SEQ ID NO: 581702 - DNA, 449 bp, Homo sapiens
  misc_feature: HIJSMM301A43EE.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtgcagcatgggatgacaccctgaatggtccttgtgtggttttcggcggagggaccaagctgaccgtcctaggtcagcccaaggctgccccctcggtcactctgttcccgccctcctcgtatctctg

SEQ ID NO: 581703 - DNA, 498 bp, Homo sapiens; identical to SEQ ID NO: 537020
  misc_feature: HIJSMM301BPLJJ.26.26.C04.1.454.light.4.raw

SEQ ID NO: 581704 - DNA, 484 bp, Homo sapiens; identical to SEQ ID NO: 546338
  misc_feature: HIJSMM301D9VGR.52.69.G03.1.454.light.4.raw

SEQ ID NO: 581705 - DNA, 485 bp, Homo sapiens; identical to SEQ ID NO: 535606
  misc_feature: HIJSMM301CMCTZ.47.46.E02.1.454.light.4.raw

SEQ ID NO: 581706 - DNA, 484 bp, Homo sapiens; identical to SEQ ID NO: 535240
  misc_feature: HIJSMM301AFT28.47.60.F05.1.454.light.4.raw

SEQ ID NO: 581707 - DNA, 486 bp, Homo sapiens
  misc_feature: HIJSMM301CNJ5D.46.67.G01.1.454.light.4.raw
actagcagtacacgaccggtgctcgatttagagtatacatattgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 581708 - DNA, 504 bp, Homo sapiens
  misc_feature: HIJSMM301C7SQT.41.38.D05.1.454.light.4.raw
  modified_base (419)..(419): a, c, t, g, unknown or other
tctatactatcacgaccggtgctcgatttagtatctgatagttgggtttgggggccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggtattttgcgtacttactattgtcaacaggcgtnacgttcgttcctcctactcgttcggcggacggacgaggtagagacaaacgaactgtggctgcacatctgtcttcatccttccccg

SEQ ID NO: 581709 - DNA, 494 bp, Homo sapiens; identical to SEQ ID NO: 574391
  misc_feature: HIJSMM301BW6MS.22.5.A05.1.454.light.4.raw

SEQ ID NO: 581710 - DNA, 506 bp, Homo sapiens
  misc_feature: HIJSMM301AR3P7.5.86.H09.1.454.light.4.raw
atcagacacgcacgaccggtgctcgatttagtgctatagacttggggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtcta

SEQ ID NO: 581711 - DNA, 493 bp, Homo sapiens
  misc_feature: HIJSMM301DF1BU.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccgaagggaccaaggtggaaatcaaacgaactagtggctgcaccat

SEQ ID NO: 581712 - DNA, 487 bp, Homo sapiens
  misc_feature: HIJSMM301EVKJU.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaagggacacgactggagattaaagaaaccctgtggctgcaccat

SEQ ID NO: 581713 - DNA, 447 bp, Homo sapiens; identical to SEQ ID NO: 535201
  misc_feature: HIJSMM301CRWZO.18.9.A09.1.454.light.4.raw

SEQ ID NO: 581714 - DNA, 489 bp, Homo sapiens; identical to SEQ ID NO: 535139
  misc_feature: HIJSMM301B6NZP.14.55.E11.1.454.light.4.raw

SEQ ID NO: 581715 - DNA, 522 bp, Homo sapiens; identical to SEQ ID NO: 540296
  misc_feature: HIJSMM301AXJBL.5.27.C05.1.454.light.4.raw

SEQ ID NO: 581716 - DNA, 517 bp, Homo sapiens
  misc_feature: HIJSMM301ANV78.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttacactgtcagcagtatgttacgtccccgtggacgttcggccaaggaccgaaggtggcaatcaaccgaactgtggctgcaccatctgtcttcatcttccccg

SEQ ID NO: 581717 - DNA, 490 bp, Homo sapiens; identical to SEQ ID NO: 535234
  misc_feature: HIJSMM301B2NTP.17.21.B10.1.454.light.4.raw

SEQ ID NO: 581718 - DNA, 491 bp, Homo sapiens; identical to SEQ ID NO: 535294
  misc_feature: HIJSMM301E2GZ2.16.68.G02.1.454.light.4.raw

SEQ ID NO: 581719 - DNA, 523 bp, Homo sapiens
  misc_feature: HIJSMM301AQ9VM.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactcggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccgcct

SEQ ID NO: 581720 - DNA, 500 bp, Homo sapiens; identical to SEQ ID NO: 542309
  misc_feature: HIJSMM301AFO79.12.86.H09.1.454.light.4.raw

SEQ ID NO: 581721 - DNA, 484 bp, Homo sapiens
  misc_feature: HIJSMM301BEBRW.4.2.A02.1.454.light.4.raw
agcactgtagcacgaccggtgctcgatttagactcatctacaggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtcttcta

SEQ ID NO: 581722 - DNA, 510 bp, Homo sapiens
  misc_feature: HIJSMM301D964D.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatggacaatctgagcggttgggtgttcgggcggaggggacccaaactggaccgttcctagggtcagccccaa

SEQ ID NO: 581723 - DNA, 487 bp, Homo sapiens
  misc_feature: HIJSMM301EXY4Y.3.19.B08.1.454.light.4.raw
agacgcactccacgaccggtgctcgatttagtgagtcagtaagggggcaggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgt

SEQ ID NO: 581724 - DNA, 494 bp, Homo sapiens
  misc_feature: HIJSMM301CZT9P.19.71.G05.1.454.light.4.raw
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggccaagggaccaaggtggatatcagacgaactgtggctgcaa

SEQ ID NO: 581725 - DNA, 487 bp, Homo sapiens; identical to SEQ ID NO: 535583
  misc_feature: HIJSMM301AJC05.22.73.G07.1.454.light.4.raw

SEQ ID NO: 581726 - DNA, 487 bp, Homo sapiens; identical to SEQ ID NO: 546164
  misc_feature: HIJSMM301AY0AU.5.6.A06.1.454.light.4.raw

SEQ ID NO: 581727 - DNA, 501 bp, Homo sapiens; identical to SEQ ID NO: 537545
  misc_feature: HIJSMM301EQORT.49.69.G03.1.454.light.4.raw

SEQ ID NO: 581728 - DNA, 510 bp, Homo sapiens
  misc_feature: HIJSMM301EB9XB.13.73.G07.1.454.light.4.raw
tcacgtactacacgaccggtgctcgatttagctctacgctcaggggggggtcgacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggccaaccccactgtcactctgttccc

SEQ ID NO: 581729 - DNA, 509 bp, Homo sapiens
  misc_feature: HIJSMM301B701K.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaaggaccaacggtaggaaagtacaagacgaactgtggctggcaccatctcgtcttctactcttcccgt

SEQ ID NO: 581730 - DNA, 479 bp, Homo sapiens
  misc_feature: HIJSMM301CEOM9.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacacgcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggac

SEQ ID NO: 581731 - DNA, 404 bp, Homo sapiens; identical to SEQ ID NO: 535530
  misc_feature: HIJSMM301EH6NN.4.35.D02.1.454.light.4.raw

SEQ ID NO: 581732 - DNA, 471 bp, Homo sapiens; identical to SEQ ID NO: 579376
  misc_feature: HIJSMM301EHPL0.49.4.A04.1.454.light.4.raw

SEQ ID NO: 581733 - DNA, 377 bp, Homo sapiens; identical to SEQ ID NO: 536071
  misc_feature: HIJSMM301DPMVC.40.9.A09.1.454.light.4.raw

SEQ ID NO: 581734 - DNA, 488 bp, Homo sapiens
  misc_feature: HIJSMM301EFLJC.22.77.G11.1.454.light.4.raw
acatacgcgtcacgaccggtgctcgatttagctagtcactcaagggaaagggggagtcagtctcagtcaggacacagcatggacatgagggtccccgctcagctcctggggctcctgctactctggctccgaggtgccaggtgtgacatccagatgacccagtctccatcctcccggtctgcatctgttggagaaagaatcaccatcacttgtcgggcaagtcagagcattgatatccttttaaactggtatcatcagagaccagggaaggcccctaagttcctgatccatgatgcatccactctgcagagtggagtcccatccaggttcagtggcagtgggtctgggacagagttcactctcaccatcaacagtctgcagccagaggactttggaacctactattgccaacagacttacacgttaccccccccacgttccggcggacgggaccacagtcgagatcaaacgaactgtggctgcaccat

SEQ ID NO: 581735 - DNA, 486 bp, Homo sapiens; identical to SEQ ID NO: 535043
  misc_feature: HIJSMM301AV03I.46.35.D02.1.454.light.4.raw

SEQ ID NO: 581736 - DNA, 510 bp, Homo sapiens
  misc_feature: HIJSMM301AHUOA.4.57.F02.1.454.light.4.raw
  modified_base (491)..(491): a, c, t, g, unknown or other
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccncctagtcactctgttccgt

SEQ ID NO: 581737 - DNA, 455 bp, Homo sapiens; identical to SEQ ID NO: 550155
  misc_feature: HIJSMM301BSYCI.5.86.H09.1.454.light.4.raw

SEQ ID NO: 581738 - DNA, 444 bp, Homo sapiens; identical to SEQ ID NO: 535192
  misc_feature: HIJSMM301DGND0.5.9.A09.1.454.light.4.raw

SEQ ID NO: 581739 - DNA, 487 bp, Homo sapiens; identical to SEQ ID NO: 567716
  misc_feature: HIJSMM301ARMH6.19.71.G05.1.454.light.4.raw

SEQ ID NO: 581740 - DNA, 555 bp, Homo sapiens
  misc_feature: HIJSMM301BBYWU.4.39.D06.1.454.light.4.raw
  modified_base (435)..(435): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattactactgctgctccttgctaggcnccgtctgttacctactaggtcagtacttacgtcggtacggttaccggaaaacttcggggaacccgtaacgttacggtaacccgtcgtccgggtacgacgtcccgaaacccggtacccccg

SEQ ID NO: 581741 - DNA, 491 bp, Homo sapiens; identical to SEQ ID NO: 548535
  misc_feature: HIJSMM301AV3ZX.51.71.G05.1.454.light.4.raw

SEQ ID NO: 581742 - DNA, 491 bp, Homo sapiens; identical to SEQ ID NO: 535176
  misc_feature: HIJSMM301C76Q9.13.39.D06.1.454.light.4.raw

SEQ ID NO: 581743 - DNA, 488 bp, Homo sapiens
  misc_feature: HIJSMM301DD6H0.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagattttcactctcaccgtcagcagtctgcaacctgaagattttgcaacttctactgtcaacagagttacagtacccccctcactttcggcggagggaccaaggcggagatcagacgaactgtggctgcaccatctgtcttca

SEQ ID NO: 581744 - DNA, 454 bp, Homo sapiens; identical to SEQ ID NO: 536943
  misc_feature: HIJSMM301A87GE.19.86.H09.1.454.light.4.raw

SEQ ID NO: 581745 - DNA, 499 bp, Homo sapiens; identical to SEQ ID NO: 537739
  misc_feature: HIJSMM301B5QSZ.12.86.H09.1.454.light.4.raw

SEQ ID NO: 581746 - DNA, 503 bp, Homo sapiens; identical to SEQ ID NO: 546075
  misc_feature: HIJSMM301DWNUF.7.71.G05.1.454.light.4.raw

SEQ ID NO: 581747 - DNA, 505 bp, Homo sapiens; identical to SEQ ID NO: 536792
  misc_feature: HIJSMM301BGZSF.48.33.C11.1.454.light.4.raw

SEQ ID NO: 581748 - DNA, 474 bp, Homo sapiens
  misc_feature: HIJSMM301EID4H.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaacgttcggccaagggaccgaacggtggaaatacaaacgaactagt

SEQ ID NO: 581749 - DNA, 487 bp, Homo sapiens
  misc_feature: HIJSMM301B4T6J.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataattactggtctttttggccaggggaccaagctggagatcaagcgaactgtggctgcaccatctgtt

SEQ ID NO: 581750 - DNA, 444 bp, Homo sapiens; identical to SEQ ID NO: 534993
  misc_feature: HIJSMM301ENLBM.5.9.A09.1.454.light.4.raw

SEQ ID NO: 581751 - DNA, 494 bp, Homo sapiens; identical to SEQ ID NO: 535276
  misc_feature: HIJSMM301A6D92.16.6.A06.1.454.light.4.raw

SEQ ID NO: 581752 - DNA, 502 bp, Homo sapiens
  misc_feature: HIJSMM301DTSC8.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtcttggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaccaaactgaccgtcttaggtcagcccaaggctgcccccc

SEQ ID NO: 581753 - DNA, 495 bp, Homo sapiens; identical to SEQ ID NO: 551467
  misc_feature: HIJSMM301EXFFQ.26.12.B01.1.454.light.4.raw

SEQ ID NO: 581754 - DNA, 484 bp, Homo sapiens; identical to SEQ ID NO: 535240
  misc_feature: HIJSMM301BEDCQ.47.60.F05.1.454.light.4.raw

SEQ ID NO: 581755 - DNA, 480 bp, Homo sapiens
  misc_feature: HIJSMM301A9PO5.52.53.E09.1.454.light.4.raw
cgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcagggggacgtatccctgatcgcttctcaggctccggctctgggactgagcgctacctcaccatctccagcctccagtctgaggacgagggtgactattactgtcagacgtgggacactggcatttgggtgttcggcggaggaccaagttgaccgtctaggtcagcccaaggctcg

SEQ ID NO: 581756 - DNA, 511 bp, Homo sapiens
  misc_feature: HIJSMM301BGX4S.12.53.E09.1.454.light.4.raw
  modified_base (493)..(493): a, c, t, g, unknown or other
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcgggattattactgttgctcatatgcgggtagtagcactttcgatgtcctattcggtcggagggaccgaagcttgaccgtcctcgggtcagcccaaggctgccccctccggtcactctgttcccnccctcctctacgtcgtat

SEQ ID NO: 581757 - DNA, 487 bp, Homo sapiens
  misc_feature: HIJSMM301C9X7Q.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgagattttgcaacttactactgtcaacagagttacggtaccccgtacacttttggccaggggaccaaactggacatcaaacgaactgtggctgcaccatctgtt

SEQ ID NO: 581758 - DNA, 486 bp, Homo sapiens
  misc_feature: HIJSMM301E0P0R.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaaatacttatctttatgtctttcggatctggaccagggtcaccgtcctagtcagcccaaggccaaa

SEQ ID NO: 581759 - DNA, 509 bp, Homo sapiens
  misc_feature: HIJSMM301AHUCV.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggctgtccccccg

SEQ ID NO: 581760 - DNA, 494 bp, Homo sapiens
  misc_feature: HIJSMM301CCV7L.21.27.C05.1.454.light.4.raw
  modified_base (198)..(198): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttattctgccagcaatataattactggcctgcgtcgacgttcggccacgggaccaaggtggaaatcaaacgaactgtggctgcaccatctgtctt

SEQ ID NO: 581761 - DNA, 496 bp, Homo sapiens; identical to SEQ ID NO: 574701
  misc_feature: HIJSMM301A4TE9.51.35.D02.1.454.light.4.raw

SEQ ID NO: 581762 - DNA, 489 bp, Homo sapiens; identical to SEQ ID NO: 538498
  misc_feature: HIJSMM301DCW46.19.71.G05.1.454.light.4.raw

SEQ ID NO: 581763 - DNA, 510 bp, Homo sapiens
  misc_feature: HIJSMM301D9JHN.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtcggaaatcaaacgaactagtggctgcaccatctgtctt

SEQ ID NO: 581764 - DNA, 446 bp, Homo sapiens; identical to SEQ ID NO: 537330
  misc_feature: HIJSMM301BJ5NC.18.9.A09.1.454.light.4.raw

SEQ ID NO: 581765 - DNA, 499 bp, Homo sapiens
  misc_feature: HIJSMM301BUSFC.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttgattggtacctgcagaagccagggcagtctccacagctcctgatctatttgggttctaatcgggcctccggggtccctgacaggttcagtggcagtggatcaggcacagattttacactagaaaatcagcagagtggaggctgaggatggttggggtttagttactgcatgcaagctctacaaactaccttactacttttggccgagggaccgaagcgtggagatacaaacgaacgtgt

SEQ ID NO: 581766 - DNA, 492 bp, Homo sapiens; identical to SEQ ID NO: 535126
  misc_feature: HIJSMM301BQOIT.18.11.A11.1.454.light.4.raw

SEQ ID NO: 581767 - DNA, 454 bp, Homo sapiens; identical to SEQ ID NO: 536347
  misc_feature: HIJSMM301ALGPM.19.86.H09.1.454.light.4.raw

SEQ ID NO: 581768 - DNA, 505 bp, Homo sapiens; identical to SEQ ID NO: 536254
  misc_feature: HIJSMM301AI72O.7.71.G05.1.454.light.4.raw

SEQ ID NO: 581769 - DNA, 498 bp, Homo sapiens; identical to SEQ ID NO: 542913
  misc_feature: HIJSMM301EU2SF.51.26.C04.1.454.light.4.raw

SEQ ID NO: 581770 - DNA, 512 bp, Homo sapiens
  misc_feature: HIJSMM301AU4F1.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattacttgtcaacagtttttctcggggcgttcggccgaagggaccgaaggtaggaaagtacaaaacgaactagtggctgcaccatctgtcttcatcttccccg

SEQ ID NO: 581771 - DNA, 455 bp, Homo sapiens
  misc_feature: HIJSMM301CFRBQ.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaatcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccccaccctcctccacgacgagta

SEQ ID NO: 581772 - DNA, 496 bp, Homo sapiens; identical to SEQ ID NO: 537925
  misc_feature: HIJSMM301DL3TR.22.14.B03.1.454.light.4.raw

SEQ ID NO: 581773 - DNA, 496 bp, Homo sapiens
  misc_feature: HIJSMM301DIR4Q.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagtacaggttcagtggcagtgggtctgggacagacttcactctcaccatcagcagactggagcctgaggattttgcagtgtattactgtcagcagtatcataggtcaaacaccttcggccaaggacgacgactggagattaaaggaaactgtggctgcaccatctgtcttcatcttccccg

SEQ ID NO: 581774 - DNA, 484 bp, Homo sapiens; identical to SEQ ID NO: 535400
  misc_feature: HIJSMM301B2NPR.46.26.C04.1.454.light.4.raw

SEQ ID NO: 581775 - DNA, 473 bp, Homo sapiens; identical to SEQ ID NO: 535262
  misc_feature: HIJSMM301ER0A4.8.67.G01.1.454.light.4.raw

SEQ ID NO: 581776 - DNA, 488 bp, Homo sapiens; identical to SEQ ID NO: 539884
  misc_feature: HIJSMM301A6QF0.7.85.H08.1.454.light.4.raw

SEQ ID NO: 581777 - DNA, 507 bp, Homo sapiens
  misc_feature: HIJSMM301BQNFB.43.62.F07.1.454.light.4.raw
tgtgagtagtcacgaccggtgctcgatttagtagtcgcataaagggaaagggggagtcagtctacagtcaggacacagcatggacatgagggtccccgctcagctcctggggctcctgctactctggctccgaggtgccagatgtgacatccagttgacgcagtctccatcctccctgtctagcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactgtaggctgcgaccatctgtcttcattcttccccg

SEQ ID NO: 581778 - DNA, 512 bp, Homo sapiens
  misc_feature: HIJSMM301D35NH.48.71.G05.1.454.light.4.raw
agtatacatacacgaccggtgctcgatttagtgtcgtcgcaagagagagggggaagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgtcagcagtatggaagttcacctcggacattcggccaggggaccaaggtggaaaatcaaaacgaactgtggcgtgcaccaactctgtcttctactcttcccgt

SEQ ID NO: 581779 - DNA, 497 bp, Homo sapiens
  misc_feature: HIJSMM301BCJ0K.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagttccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 581780 - DNA, 508 bp, Homo sapiens
  misc_feature: HIJSMM301E04V0.40.16.B05.1.454.light.4.raw
tctagcgactcacgaccggtgctcgatttagagctcacgtaaggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagtttttgggtgtttcggcggagggaccaagctgaccgtcctaggtcagcccaaggctgccccctcggtcactctgttcccg

SEQ ID NO: 581781 - DNA, 514 bp, Homo sapiens
  misc_feature: HIJSMM301CVWIN.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtcggccgtccggggcctacgtttcggccctcgggaccaagggtggagagtcaaacgaactgtggctgcaccatctgtcttcta

SEQ ID NO: 581782 - DNA, 489 bp, Homo sapiens
  misc_feature: HIJSMM301DZLQE.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatacaaacgaactgtggctgcaccatctgtt

SEQ ID NO: 581783 - DNA, 493 bp, Homo sapiens
  misc_feature: HIJSMM301B62PQ.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttta

SEQ ID NO: 581784 - DNA, 501 bp, Homo sapiens
  misc_feature: HIJSMM301EG3AJ.48.85.H08.1.454.light.4.raw
agtatacatacacgaccggtgctcgatttagtatcactcagtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttcccgt

SEQ ID NO: 581785 - DNA, 497 bp, Homo sapiens; identical to SEQ ID NO: 535286
  misc_feature: HIJSMM301ELBI7.18.59.F04.1.454.light.4.raw

SEQ ID NO: 581786 - DNA, 539 bp, Homo sapiens
  misc_feature: HIJSMM301BBT17.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccgaacggaccgaacggtacggaaagtactaacggacgaaccgtacgtggtcgtcggtcgaccctaactacctcgttctttcctacttcttccccgtt

SEQ ID NO: 581787 - DNA, 496 bp, Homo sapiens; identical to SEQ ID NO: 535109
  misc_feature: HIJSMM301EXCA5.16.78.H01.1.454.light.4.raw

SEQ ID NO: 581788 - DNA, 500 bp, Homo sapiens
  misc_feature: HIJSMM301DVSAG.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccgaggctgaggacgaggctgattattactgcagctcatataacgaagcaccagcactctctatgtcttcggaactgggaccaaggtcaccgtcctaggtcagcccaagg

SEQ ID NO: 581789 - DNA, 521 bp, Homo sapiens; identical to SEQ ID NO: 539470
  misc_feature: HIJSMM301A6PBL.27.23.C01.1.454.light.4.raw

SEQ ID NO: 581790 - DNA, 487 bp, Homo sapiens; identical to SEQ ID NO: 537220
  misc_feature: HIJSMM301AMBG4.16.53.E09.1.454.light.4.raw

SEQ ID NO: 581791 - DNA, 492 bp, Homo sapiens; identical to SEQ ID NO: 556964
  misc_feature: HIJSMM301B4G0O.26.78.H01.1.454.light.4.raw

SEQ ID NO: 581792 - DNA, 492 bp, Homo sapiens
  misc_feature: HIJSMM301B7QE9.13.87.H10.1.454.light.4.raw
tcacgtactacacgaccggtgctcgatttagcagtactgcgttggggtttggggagtcagtcccagtcaggacacagcatggacatgagggtccccgctcagctcctggggctcctgctgctctggctcccaggtgccagatgtgacatccagttgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtacttacggaacctcgtacacttttggccaggggaccaggcgtggagatacaaacgaactgtggctgcaccatctgtt

SEQ ID NO: 581793 - DNA, 487 bp, Homo sapiens
  misc_feature: HIJSMM301B6KQN.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgtcggtccaagggaccgaacgtggatatcagacgaa

SEQ ID NO: 581794 - DNA, 480 bp, Homo sapiens
  misc_feature: HIJSMM301C3V0I.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattatgcatgcaagctctacaaactcctctcactttcggcgagggaccaaggtgagatcaaacgaa

SEQ ID NO: 581795 - DNA, 495 bp, Homo sapiens; identical to SEQ ID NO: 535821
  misc_feature: HIJSMM301CIV3X.3.31.C09.1.454.light.4.raw

SEQ ID NO: 581796 - DNA, 507 bp, Homo sapiens
  misc_feature: HIJSMM301CD54I.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaatcaaacgaactagtggctgcaccatctgtcttcacttcttcccccg

SEQ ID NO: 581797 - DNA, 503 bp, Homo sapiens
  misc_feature: HIJSMM301EPQC7.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaggccaactccactgtcact

SEQ ID NO: 581798 - DNA, 484 bp, Homo sapiens
  misc_feature: HIJSMM301EUX10.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaaggaccgaaggtaggaaagtacaaacgaaactgtggctgcacca

SEQ ID NO: 581799 - DNA, 504 bp, Homo sapiens; identical to SEQ ID NO: 542968
  misc_feature: HIJSMM301B9LBT.11.57.F02.1.454.light.4.raw

SEQ ID NO: 581800 - DNA, 514 bp, Homo sapiens
  misc_feature: HIJSMM301EQZEX.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagcggagatgaggccgactattactgtcaggtgtgggacagtaatagtgatcccgagcaggtttcggcggtgggaccaagctgaccgtccgtaagtacagacccaacgcgtcgccccctccggtcactctcgtt

SEQ ID NO: 581801 - DNA, 503 bp, Homo sapiens; identical to SEQ ID NO: 562029
  misc_feature: HIJSMM301D23HU.21.22.B11.1.454.light.4.raw

SEQ ID NO: 581802 - DNA, 474 bp, Homo sapiens; identical to SEQ ID NO: 558221
  misc_feature: HIJSMM301C3ZS6.12.49.E05.1.454.light.4.raw

SEQ ID NO: 581803 - DNA, 491 bp, Homo sapiens; identical to SEQ ID NO: 535176
  misc_feature: HIJSMM301A0U45.13.39.D06.1.454.light.4.raw

SEQ ID NO: 581804 - DNA, 517 bp, Homo sapiens; identical to SEQ ID NO: 564566
  misc_feature: HIJSMM301ATNOA.14.66.F11.1.454.light.4.raw

SEQ ID NO: 581805 - DNA, 475 bp, Homo sapiens; identical to SEQ ID NO: 551151
  misc_feature: HIJSMM301EGC41.13.76.G10.1.454.light.4.raw

SEQ ID NO: 581806 - DNA, 498 bp, Homo sapiens
  misc_feature: HIJSMM301CF68I.10.65.F10.1.454.light.4.raw
catagtagtgcacgaccggtgctcgatttagctacgctctaagggggcagggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtccctcaaggttcagtggcagtggatctgggacagactttactctcaccatcagcgatctgcagcctgacgattttgcgacttactactgtcaacagagtttccggaaccccgttactttcggcggagggaccaaggtgagatcaaacgaactgtggctgcaccatctgtcttcatcttccccg

SEQ ID NO: 581807 - DNA, 505 bp, Homo sapiens; identical to SEQ ID NO: 536117
  misc_feature: HIJSMM301DF2LZ.8.71.G05.1.454.light.4.raw

SEQ ID NO: 581808 - DNA, 486 bp, Homo sapiens
  misc_feature: HIJSMM301CHU5I.15.28.C06.1.454.light.4.raw
tctacgtagccacgaccggtgctcgatttagagctcacgtattgggtttggggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtgggatctgggacagaattcagtctcaccatcagcagcctgcagcctgacgattttgcaacttactactgccaagtgcataatatcatttcggcggagggaccaaggtggagatcaaacgaactgtggctgcacatctgtcttcatt

SEQ ID NO: 581809 - DNA, 447 bp, Homo sapiens; identical to SEQ ID NO: 535882
  misc_feature: HIJSMM301ERRMY.18.9.A09.1.454.light.4.raw
  modified_base (429)..(429): a, c, t, g, unknown or other

SEQ ID NO: 581810 - DNA, 522 bp, Homo sapiens
  misc_feature: HIJSMM301CTMTZ.49.27.C05.1.454.light.4.raw
agtcgagagacacgaccggtgctcgatttagacgcgatcgaagggtttgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtcctaggtcagcccaaggctgccccctcggtcactctgttcccaccctcctctctctcgactc

SEQ ID NO: 581811 - DNA, 515 bp, Homo sapiens; identical to SEQ ID NO: 540368
  misc_feature: HIJSMM301DKCU6.16.88.H11.1.454.light.4.raw

SEQ ID NO: 581812 - DNA, 489 bp, Homo sapiens
  misc_feature: HIJSMM301C9QI6.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaaagctgccctcaccatcacgggggcccaggcagatgatgaatctcattattactgtgcactgcatttgcgtgatgtcaattatgtgttcggcggagggaa

SEQ ID NO: 581813 - DNA, 486 bp, Homo sapiens; identical to SEQ ID NO: 535043
  misc_feature: HIJSMM301DC4SX.46.35.D02.1.454.light.4.raw

SEQ ID NO: 581814 - DNA, 488 bp, Homo sapiens
  misc_feature: HIJSMM301AWSQ4.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttatactgccaacaatatgatatttattctccagcgttcggccaggggaccaaggtggaagtcaagcgaactgtggctgcaccatctgtt

SEQ ID NO: 581815 - DNA, 501 bp, Homo sapiens
  misc_feature: HIJSMM301CJUY3.13.11.A11.1.454.light.4.raw
tcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctcg

SEQ ID NO: 581816 - DNA, 489 bp, Homo sapiens
  misc_feature: HIJSMM301DGV60.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgaaccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcacg

SEQ ID NO: 581817 - DNA, 512 bp, Homo sapiens
  misc_feature: HIJSMM301BSVS1.51.38.D05.1.454.light.4.raw
cgatcgtatacacgaccggtgctcgatttagtatctgatagttgggtttgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatccaataacaattgggtgttcggcggagggaccaaactgaccgtcctaggtcagcccaaggctgccccctcggtcactctcg

SEQ ID NO: 581818 - DNA, 492 bp, Homo sapiens
  misc_feature: HIJSMM301BCX7R.51.62.F07.1.454.light.4.raw
cgatcgtatacacgaccggtgctcgatttagtagtcgcataaagggaaagggggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggactaaatttttcttcaccatcaccaacctgcaacctgaggattttgcaacatatttctgtcaacaatatgataatgtccccaccgtcactttcggcggagggaccaaggtggacctcaaacgaactgtggctgcaccatctgtt

SEQ ID NO: 581819 - DNA, 465 bp, Homo sapiens; identical to SEQ ID NO: 561175
  misc_feature: HIJSMM301CA0ZC.13.4.A04.1.454.light.4.raw

SEQ ID NO: 581820 - DNA, 464 bp, Homo sapiens; identical to SEQ ID NO: 536640
  misc_feature: HIJSMM301A5CV4.26.78.H01.1.454.light.4.raw

SEQ ID NO: 581821 - DNA, 486 bp, Homo sapiens; identical to SEQ ID NO: 535458
  misc_feature: HIJSMM301B9XZS.7.75.G09.1.454.light.4.raw

SEQ ID NO: 581822 - DNA, 492 bp, Homo sapiens
  misc_feature: HIJSMM301EV4LH.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagcccaaggctcgcccccg

SEQ ID NO: 581823 - DNA, 485 bp, Homo sapiens; identical to SEQ ID NO: 535985
  misc_feature: HIJSMM301EJ4HX.15.1.A01.1.454.light.4.raw

SEQ ID NO: 581824 - DNA, 495 bp, Homo sapiens; identical to SEQ ID NO: 543094
  misc_feature: HIJSMM301B5NI4.22.57.F02.1.454.light.4.raw

SEQ ID NO: 581825 - DNA, 518 bp, Homo sapiens; identical to SEQ ID NO: 544387
  misc_feature: HIJSMM301DM8ZK.19.80.H03.1.454.light.4.raw

SEQ ID NO: 581826 - DNA, 513 bp, Homo sapiens
  misc_feature: HIJSMM301AFMRZ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattcttccagcgttcggtccgacggggaccggaacggtagggaaggtacgtaaggacgaacgtacgtggcgtgtcacccactctgttcc

SEQ ID NO: 581827 - DNA, 475 bp, Homo sapiens
  misc_feature: HIJSMM301C1YL1.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggaggaccaaggtggagatcaacgaactgtggctgcta

SEQ ID NO: 581828 - DNA, 507 bp, Homo sapiens; identical to SEQ ID NO: 535641
  misc_feature: HIJSMM301EK35M.10.88.H11.1.454.light.4.raw

SEQ ID NO: 581829 - DNA, 464 bp, Homo sapiens
  misc_feature: HIJSMM301DET2F.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagttttattactgtcaacatcgtaccgagtggcctccgggggccactttcggccctgggaccaaagtggagatcaaacgaactgtggctgcaccatctgtcttcatcttcccgccatctgacactactatg

SEQ ID NO: 581830 - DNA, 498 bp, Homo sapiens; identical to SEQ ID NO: 537020
  misc_feature: HIJSMM301BHFEC.26.26.C04.1.454.light.4.raw

SEQ ID NO: 581831 - DNA, 490 bp, Homo sapiens
  misc_feature: HIJSMM301DD0ET.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggacaaggtggaggtcaaacgaactgtggctgcaccatctgtcttcatt

SEQ ID NO: 581832 - DNA, 489 bp, Homo sapiens; identical to SEQ ID NO: 535139
  misc_feature: HIJSMM301D3LJJ.14.55.E11.1.454.light.4.raw

SEQ ID NO: 581833 - DNA, 442 bp, Homo sapiens; identical to SEQ ID NO: 563958
  misc_feature: HIJSMM301CR8WW.11.3.A03.1.454.light.4.raw

SEQ ID NO: 581834 - DNA, 518 bp, Homo sapiens
  misc_feature: HIJSMM301EJ79Y.8.87.H10.1.454.light.4.raw
ctcgcgtgtccacgaccggtgctcgatttagcagtactgcgttgggtttggggctgggcctcaggaagcagcatcgggggtgccgcagccatggcctggaccgctctccttctgagcctccttgctcactttacaggttctgtggcctcctatgaactgacacagccactctcagtgtcagtggccctgggacagacggccagaattacctgtggaggagtcaacattgggacttcagatgtgcactggtaccagcagaagccaggccaggcccctgtactggtcatctttagcgattccaaccggccctctgggatccctgagcgattctctggctccaagtcggggaacacggccaccctgaccatcagcagggcccaacccttggatgagggtgactattctgtcaagtgtgggacaccaacacttgtgtcttcgggactgggaccgaggtcaccgtcctaagtcagcccagggccaaccccactgtcactctcgttcccaccctcctcgacacg

SEQ ID NO: 581835 - DNA, 489 bp, Homo sapiens; identical to SEQ ID NO: 535139
  misc_feature: HIJSMM301EHSUX.14.55.E11.1.454.light.4.raw

SEQ ID NO: 581836 - DNA, 486 bp, Homo sapiens; identical to SEQ ID NO: 537238
  misc_feature: HIJSMM301DMBV6.19.71.G05.1.454.light.4.raw

SEQ ID NO: 581837 - DNA, 512 bp, Homo sapiens
  misc_feature: HIJSMM301AURTT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctcgggcgttcggtccaagggaccgaaggtaggaaagtacaaacgaactagtggctgcaccactctgtcttctatcttccccg

SEQ ID NO: 581838 - DNA, 488 bp, Homo sapiens; identical to SEQ ID NO: 535861
  misc_feature: HIJSMM301C42FN.14.55.E11.1.454.light.4.raw

SEQ ID NO: 581839 - DNA, 487 bp, Homo sapiens
  misc_feature: HIJSMM301CU91G.21.4.A04.1.454.light.4.raw
tcgtcgctcgcacgaccggtgctcgatttagagtagtgatcagggggaagagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccagcagaagcctggccaggctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtgctgcaccat

SEQ ID NO: 581840 - DNA, 490 bp, Homo sapiens; identical to SEQ ID NO: 537951
  misc_feature: HIJSMM301A46ED.19.57.F02.1.454.light.4.raw

SEQ ID NO: 581841 - DNA, 493 bp, Homo sapiens; identical to SEQ ID NO: 577540
  misc_feature: HIJSMM301E0GAG.16.68.G02.1.454.light.4.raw

SEQ ID NO: 581842 - DNA, 522 bp, Homo sapiens; identical to SEQ ID NO: 541090
  misc_feature: HIJSMM301B83WP.27.23.C01.1.454.light.4.raw

SEQ ID NO: 581843 - DNA, 487 bp, Homo sapiens; identical to SEQ ID NO: 537079
  misc_feature: HIJSMM301DK8G9.14.55.E11.1.454.light.4.raw

SEQ ID NO: 581844 - DNA, 500 bp, Homo sapiens; identical to SEQ ID NO: 544063
  misc_feature: HIJSMM301DCBVE.12.18.B07.1.454.light.4.raw

SEQ ID NO: 581845 - DNA, 505 bp, Homo sapiens; identical to SEQ ID NO: 538911
  misc_feature: HIJSMM301DS77P.9.12.B01.1.454.light.4.raw

SEQ ID NO: 581846 - DNA, 489 bp, Homo sapiens
  misc_feature: HIJSMM301CFF4F.48.53.E09.1.454.light.4.raw
agtatacatacacgaccggtgctcgatttagagagagtgtgttgggtttgggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaaactgtggctgca

SEQ ID NO: 581847 - DNA, 489 bp, Homo sapiens; identical to SEQ ID NO: 535091
  misc_feature: HIJSMM301EG2AO.47.36.D03.1.454.light.4.raw

SEQ ID NO: 581848 - DNA, 497 bp, Homo sapiens
  misc_feature: HIJSMM301CB3LY.11.59.F04.1.454.light.4.raw
  modified_base (465)..(465): a, c, t, g, unknown or other
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaacgcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggccaaccccnctgtcactctgttccccaccctcctcgtatct

SEQ ID NO: 581849 - DNA, 515 bp, Homo sapiens
  misc_feature: HIJSMM301DYBEU.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttccccgccctcctcgagtagtaca

SEQ ID NO: 581850 - DNA, 497 bp, Homo sapiens
  misc_feature: HIJSMM301ALH90.49.6.A06.1.454.light.4.raw
agtcgagagacacgaccggtgctcgatttagatctactgacaggggggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcatatgcaggcagcaacaattttgtgatattcggcggagggaccaagctgaccgtcctaggtcagcccaaggctgccccctc

SEQ ID NO: 581851 - DNA, 505 bp, Homo sapiens
  misc_feature: HIJSMM301CAUP5.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcactctcctcgctcactgcacagggtcctgggcccagtctgttctgacgcagccgccctcagtgtctggggccccagggcagagggtcaccatctcgtacactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggtcaaccccact

SEQ ID NO: 581852 - DNA, 503 bp, Homo sapiens; identical to SEQ ID NO: 536313
  misc_feature: HIJSMM301CUDKZ.21.22.B11.1.454.light.4.raw

SEQ ID NO: 581853 - DNA, 496 bp, Homo sapiens; identical to SEQ ID NO: 537681
  misc_feature: HIJSMM301EFWOB.40.23.C01.1.454.light.4.raw

SEQ ID NO: 581854 - DNA, 503 bp, Homo sapiens; identical to SEQ ID NO: 549080
  misc_feature: HIJSMM301EJJ55.53.49.E05.1.454.light.4.raw

SEQ ID NO: 581855 - DNA, 508 bp, Homo sapiens; identical to SEQ ID NO: 535649
  misc_feature: HIJSMM301BT0HQ.47.55.E11.1.454.light.4.raw

SEQ ID NO: 581856 - DNA, 496 bp, Homo sapiens; identical to SEQ ID NO: 551761
  misc_feature: HIJSMM301C26ZH.4.27.C05.1.454.light.4.raw

SEQ ID NO: 581857 - DNA, 494 bp, Homo sapiens; identical to SEQ ID NO: 534992
  misc_feature: HIJSMM301BRCSL.9.1.A01.1.454.light.4.raw

SEQ ID NO: 581858 - DNA, 514 bp, Homo sapiens
  misc_feature: HIJSMM301ER3LF.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcaggggatccctgagcgcttctctggctccaattctgggaacacggccaccctgaccatcagcgcggtcgaagccggagatgaggccgactattactgtcaggtgtgggacagtaatagtgatcccgagcaggttttcggcggtggaccaagctgaccgtcctaagtcagcccaaggctgccccctcggtcactctgttccccg

SEQ ID NO: 581859 - DNA, 492 bp, Homo sapiens; identical to SEQ ID NO: 572751
  misc_feature: HIJSMM301AG5F3.18.22.B11.1.454.light.4.raw

SEQ ID NO: 581860 - DNA, 498 bp, Homo sapiens
  misc_feature: HIJSMM301DI4N5.53.38.D05.1.454.light.4.raw
cgcgtatacacacgaccggtgctcgatttagtatctgatagttgggtttgggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggt

SEQ ID NO: 581861 - DNA, 517 bp, Homo sapiens
  misc_feature: HIJSMM301AR29W.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccacgggaccgaacggtaggaaagtacaagacgaactacgtggtcgtgcgccatctgtcttctactcttcccgtccc

SEQ ID NO: 581862 - DNA, 506 bp, Homo sapiens; identical to SEQ ID NO: 538849
  misc_feature: HIJSMM301BRBTZ.43.15.B04.1.454.light.4.raw

SEQ ID NO: 581863 - DNA, 496 bp, Homo sapiens; identical to SEQ ID NO: 561995
  misc_feature: HIJSMM301CK0YA.16.78.H01.1.454.light.4.raw

SEQ ID NO: 581864 - DNA, 487 bp, Homo sapiens; identical to SEQ ID NO: 566828
  misc_feature: HIJSMM301D472H.19.71.G05.1.454.light.4.raw

SEQ ID NO: 581865 - DNA, 496 bp, Homo sapiens; identical to SEQ ID NO: 535541
  misc_feature: HIJSMM301B9KV0.3.33.C11.1.454.light.4.raw

SEQ ID NO: 581866 - DNA, 444 bp, Homo sapiens
  misc_feature: HIJSMM301B4AZ5.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccatcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagacgtatca

SEQ ID NO: 581867 - DNA, 521 bp, Homo sapiens; identical to SEQ ID NO: 539470
  misc_feature: HIJSMM301EQYQ6.27.23.C01.1.454.light.4.raw

SEQ ID NO: 581868 - DNA, 506 bp, Homo sapiens; identical to SEQ ID NO: 539926
  misc_feature: HIJSMM301CI4NC.5.24.C02.1.454.light.4.raw

SEQ ID NO: 581869 - DNA, 486 bp, Homo sapiens; identical to SEQ ID NO: 536555
  misc_feature: HIJSMM301EK01W.26.23.C01.1.454.light.4.raw

SEQ ID NO: 581870 - DNA, 506 bp, Homo sapiens; identical to SEQ ID NO: 534969
  misc_feature: HIJSMM301AWM2K.18.37.D04.1.454.light.4.raw

SEQ ID NO: 581871 - DNA, 494 bp, Homo sapiens
  misc_feature: HIJSMM301DJGL8.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacggctggagattaagcgaactgtggctgcaccatctgtctt

SEQ ID NO: 581872 - DNA, 502 bp, Homo sapiens; identical to SEQ ID NO: 541971
  misc_feature: HIJSMM301D7GEM.4.39.D06.1.454.light.4.raw

SEQ ID NO: 581873 - DNA, 484 bp, Homo sapiens
  misc_feature: HIJSMM301CJ68O.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggcgtgttcggtcggcgggaccg

SEQ ID NO: 581874 - DNA, 511 bp, Homo sapiens
  misc_feature: HIJSMM301CKUH1.27.78.H01.1.454.light.4.raw
  modified_base (322)..(322): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcccttttttancaagtatgcttcccacgtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaaaccg

SEQ ID NO: 581875 - DNA, 509 bp, Homo sapiens
  misc_feature: HIJSMM301EZ8JL.8.28.C06.1.454.light.4.raw
  modified_base (395)..(395): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggcctcccagactcctcatctttggcgcctttaacagggccagtggaatcccagccaggttcagcggcagtgggtctgggacttcgttcactctcaccatcaataacctgcaatctgacgtacnttttgcagtttatttctgtcagcagtctgaagactggccgtttcactttcggcgagggccaaggtggacctcaaacgaactgtggctgcaccatctgtcttcatcttcccgcca

SEQ ID NO: 581876 - DNA, 493 bp, Homo sapiens
  misc_feature: HIJSMM301BDKJM.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgccgtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttcccg

SEQ ID NO: 581877 - DNA, 445 bp, Homo sapiens
  misc_feature: HIJSMM301EM5JE.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtcgtggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgccctcctccgtgtctgat

SEQ ID NO: 581878 - DNA, 496 bp, Homo sapiens; identical to SEQ ID NO: 536248
  misc_feature: HIJSMM301D4JQ8.22.27.C05.1.454.light.4.raw

SEQ ID NO: 581879 - DNA, 492 bp, Homo sapiens
  misc_feature: HIJSMM301ARLH7.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactttgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggtcggagggaccaagctgaccgtccttggtcagcccaacggctgccccccg

SEQ ID NO: 581880 - DNA, 522 bp, Homo sapiens
  misc_feature: HIJSMM301BTGKH.27.59.F04.1.454.light.4.raw
  modified_base (457)..(457): a, c, t, g, unknown or other
  modified_base (493)..(493): a, c, t, g, unknown or other
agcgtcgtctcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggngggaccaggctgaccgtcctaggtcagcccaaggcngccccctcggtcactctgttcccacccct

SEQ ID NO: 581881 - DNA, 506 bp, Homo sapiens; identical to SEQ ID NO: 534969
  misc_feature: HIJSMM301CBAZF.18.37.D04.1.454.light.4.raw

SEQ ID NO: 581882 - DNA, 504 bp, Homo sapiens
  misc_feature: HIJSMM301BOVRV.14.3.A03.1.454.light.4.raw
cgtctagtaccacgaccggtgctcgatttagagagcgtcacaggggggggtctcaggaggcagcgctctcaggacatctccaccatggcctggactctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccgtcctaggtcagcccaaggctgcccctcggtcactctcg

SEQ ID NO: 581883 - DNA, 498 bp, Homo sapiens; identical to SEQ ID NO: 558569
  misc_feature: HIJSMM301CSW1C.51.39.D06.1.454.light.4.raw

SEQ ID NO: 581884 - DNA, 465 bp, Homo sapiens; identical to SEQ ID NO: 549748
  misc_feature: HIJSMM301EJBOB.13.4.A04.1.454.light.4.raw

SEQ ID NO: 581885 - DNA, 484 bp, Homo sapiens
  misc_feature: HIJSMM301CQMTY.40.23.C01.1.454.light.4.raw
tctagcgactcacgaccggtgctcgatttagtacacgtgattagggattgggggaggaactgctcagttaggacccagacggaaccatggaagccccagcgcagcttctcttcctcctgctactctggctcccagatagcgctggagaaatagtgatgacgcagtctccagccaccctgtctgtgtctccagggaaaagagccaccctctcctgcagggccagtgagagtgttgacacctacttagcctggtaccaacacagacctggccaggctcccaggctcctcatctctggtgcatccacccgggccactggtatcccagtcaggttcagtggcagtgggtctgggacagagttcactctcaccatcagcagcctgcagtctgaagatgttgcagtttattcctgtcagcagtacaatgactggccgtacacttttggccaggggaccaagctggagatcaaacgaactgtggctgcacc

SEQ ID NO: 581886 - DNA, 496 bp, Homo sapiens
  misc_feature: HIJSMM301BHW6G.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtatataactggcctcggacgttcggccaagggaccgaaggtggaagtcgaaacgaactagtggctgcaccatctgtcttcatcttcccg

SEQ ID NO: 581887 - DNA, 512 bp, Homo sapiens
  misc_feature: HIJSMM301CZZBU.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctcgttcccta

SEQ ID NO: 581888 - DNA, 502 bp, Homo sapiens
  misc_feature: HIJSMM301DPYBQ.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaagctgccccctggtcta

SEQ ID NO: 581889 - DNA, 497 bp, Homo sapiens; identical to SEQ ID NO: 538061
  misc_feature: HIJSMM301D9NUK.16.46.E02.1.454.light.4.raw

SEQ ID NO: 581890 - DNA, 496 bp, Homo sapiens; identical to SEQ ID NO: 535109
  misc_feature: HIJSMM301B6CI4.16.78.H01.1.454.light.4.raw

SEQ ID NO: 581891 - DNA, 477 bp, Homo sapiens; identical to SEQ ID NO: 535266
  misc_feature: HIJSMM301DV2C8.4.34.D01.1.454.light.4.raw

SEQ ID NO: 581892 - DNA, 444 bp, Homo sapiens; identical to SEQ ID NO: 536685
  misc_feature: HIJSMM301EJIQT.10.76.G10.1.454.light.4.raw

SEQ ID NO: 581893 - DNA, 494 bp, Homo sapiens
  misc_feature: HIJSMM301BLPKQ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacgacctccctgaacatctctggctccaggctgagatgaggctgattattattgctgctcatatggaagtacctacttctttctcttcggaactgggaccacggtcaccgtcctaggtcacgcccaaggcccaaccc

SEQ ID NO: 581894 - DNA, 503 bp, Homo sapiens; identical to SEQ ID NO: 538884
  misc_feature: HIJSMM301EHEDQ.27.78.H01.1.454.light.4.raw

SEQ ID NO: 581895 - DNA, 518 bp, Homo sapiens
  misc_feature: HIJSMM301EOXFQ.13.53.E09.1.454.light.4.raw
  modified_base (461)..(461): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacgaacgtaggaagtanaagacgaacgtagtaggtcgtgtcaccaactactcgttcttcctacttcttcccgtt

SEQ ID NO: 581896 - DNA, 494 bp, Homo sapiens; identical to SEQ ID NO: 535478
  misc_feature: HIJSMM301DHR6L.10.79.H02.1.454.light.4.raw

SEQ ID NO: 581897 - DNA, 484 bp, Homo sapiens; identical to SEQ ID NO: 538094
  misc_feature: HIJSMM301EOFJC.3.10.A10.1.454.light.4.raw

SEQ ID NO: 581898 - DNA, 486 bp, Homo sapiens; identical to SEQ ID NO: 535917
  misc_feature: HIJSMM301CF81Z.3.10.A10.1.454.light.4.raw

SEQ ID NO: 581899 - DNA, 504 bp, Homo sapiens; identical to SEQ ID NO: 538940
  misc_feature: HIJSMM301CVGO5.2.35.D02.1.454.light.4.raw

SEQ ID NO: 581900 - DNA, 521 bp, Homo sapiens; identical to SEQ ID NO: 539470
  misc_feature: HIJSMM301BTJHJ.27.23.C01.1.454.light.4.raw

SEQ ID NO: 581901 - DNA, 515 bp, Homo sapiens
  misc_feature: HIJSMM301D5NDP.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactacttttatgttcgggactgggaccaaggtcaccgtcctaggtcagcccaaggcccaacccactgtcactcttccg

SEQ ID NO: 581902 - DNA, 444 bp, Homo sapiens; identical to SEQ ID NO: 535027
  misc_feature: HIJSMM301ERHBS.8.73.G07.1.454.light.4.raw

SEQ ID NO: 581903 - DNA, 555 bp, Homo sapiens
  misc_feature: HIJSMM301AXHTI.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagcctccaccgactcctaccgttccggaccgaagggaccaacggaccgtagggagtaacgttaaacccgtaacgttcggtcggtcgtcgacccaaccctaacttccgttcgttcctttactactttcccccg

SEQ ID NO: 581904 - DNA, 499 bp, Homo sapiens
  misc_feature: HIJSMM301A5DIB.43.25.C03.1.454.light.4.raw
tgtgagtagtcacgaccggtgctcgatttagtagtgtagatttgggtttggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtggctgcaccatctgtt

SEQ ID NO: 581905 - DNA, 481 bp, Homo sapiens; identical to SEQ ID NO: 535993
  misc_feature: HIJSMM301D0K6X.21.25.C03.1.454.light.4.raw

SEQ ID NO: 581906 - DNA, 497 bp, Homo sapiens; identical to SEQ ID NO: 535829
  misc_feature: HIJSMM301CHM8V.5.24.C02.1.454.light.4.raw

SEQ ID NO: 581907 - DNA, 465 bp, Homo sapiens
  misc_feature: HIJSMM301DDXC0.26.78.H01.1.454.light.4.raw
agactatactcacgaccggtgctcgatttagtgtgagtagtttggggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaactgtggctgcaccatctgtcttcatcttcccccatcctgaagtatagtct

SEQ ID NO: 581908 - DNA, 512 bp, Homo sapiens
  misc_feature: HIJSMM301A7WZ4.51.86.H09.1.454.light.4.raw
cgatcgtatacacgaccggtgctcgatttagtgctatagacttgggttgggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacgagggtggaggctgaggattgtttgggttttattactgcatgcaaggtacacactggcctgggacgttcggccgaaggaccgaaggtaggaaatacaaacgaactgtggctgcacatctgtctt

SEQ ID NO: 581909 - DNA, 354 bp, Homo sapiens; identical to SEQ ID NO: 535026
  misc_feature: HIJSMM301BM5RI.19.22.B11.1.454.light.4.raw

SEQ ID NO: 581910 - DNA, 485 bp, Homo sapiens
  misc_feature: HIJSMM301CXD19.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtcctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaa

SEQ ID NO: 581911 - DNA, 475 bp, Homo sapiens
  misc_feature: HIJSMM301E0CFH.4.42.D09.1.454.light.4.raw
agcactgtagcacgaccggtgctcgatttagacacatacgcagggaaagggggaggaactgctcagttaggacccagacggaaccatggaagccccagcgcagcttctcctcctcctgctactctggctcccagataccactggagaagtagttctgatgcagtctccaggcaccctgtctgtgtctccaggggaaagagccacgctctcctgtagggccagtcagagtgtcagacataatttaggctggtaccagcagaaacctggccaggctcccaggctcctcattcatggtgcatctaacagggccgatggcatcccagccaggttcagtggcagtggatatgggacagacttcactctcaccatcagcagtctgcagtctgaagattttgctagttatttctgtcagcagttacactggcctggagtttggccagggccaagctggagctcaaacgactgtggctgcacc

SEQ ID NO: 581912 - DNA, 447 bp, Homo sapiens; identical to SEQ ID NO: 535201
  misc_feature: HIJSMM301EFR3Q.18.9.A09.1.454.light.4.raw

SEQ ID NO: 581913 - DNA, 478 bp, Homo sapiens
  misc_feature: HIJSMM301CZDMY.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagtagtcatcatcacttgccgggcaagtcagagcattagaacgtatttaaattggtatcaacagaaaccagggtaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctgggaccatagtggatatcaaacgaactgtggctgcacc

SEQ ID NO: 581914 - DNA, 498 bp, Homo sapiens
  misc_feature: HIJSMM301DKWH8.12.26.C04.1.454.light.4.raw
  modified_base (487)..(487): a, c, t, g, unknown or other
atacgacgtacacgaccggtgctcgatttagtctagcgactttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttattcaactccaacaatgagaactacttagcttggtaccagcagaaaccaggacagccgcccaagttgctcatttactgggcatctacccgggaatccggggtccctgaccgattcagtggcagcgggtctgagacagatttcactctcaccatcagcagcctgcaggccgaagatgtggcagtttattttgtcagcaatattatcatactccgctcactttcgcggagggaccaaggtggagatcaaacgaactntggctgcacca

SEQ ID NO: 581915 - DNA, 500 bp, Homo sapiens; identical to SEQ ID NO: 535310
  misc_feature: HIJSMM301BNDE4.47.66.F11.1.454.light.4.raw

SEQ ID NO: 581916 - DNA, 506 bp, Homo sapiens
  misc_feature: HIJSMM301BJZKD.21.87.H10.1.454.light.4.raw
tcgtcgctcgcacgaccggtgctcgatttagcagtactgcgttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggt

SEQ ID NO: 581917 - DNA, 474 bp, Homo sapiens
  misc_feature: HIJSMM301AMA30.3.78.H01.1.454.light.4.raw
agacgcactccacgaccggtgctcgatttagtgtgagtagtttgggtttgggcatggaagccccagcccagcttctcttcctcctgctactctggctcccagatagcaccggagaaattgtgttgacacagtctccagccaccctgtctttgtctccaggggaaagagccgccctctcctgcagggccagtcagagtgttagtagcttcttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagatttcgcagtttattactgtcagcagcgtagcaactggctgatcaccttcggccaagggacacgactggagattaaacgaactgtggctgcaccatctgtcttcatcttcccgccat

SEQ ID NO: 581918 - DNA, 502 bp, Homo sapiens
  misc_feature: HIJSMM301CID31.5.24.C02.1.454.light.4.raw
atcagacacgcacgaccggtgctcgatttagtacagatcgttagggaaagggcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcc

SEQ ID NO: 581919 - DNA, 487 bp, Homo sapiens
  misc_feature: HIJSMM301CED21.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccaccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggttttattattgtcaacaatattttagtgctccgtacacttttggccaggggaccaagttggagatcaaacgaa

SEQ ID NO: 581920 - DNA, 496 bp, Homo sapiens; identical to SEQ ID NO: 546893
  misc_feature: HIJSMM301B7XX4.51.35.D02.1.454.light.4.raw

SEQ ID NO: 581921 - DNA, 497 bp, Homo sapiens; identical to SEQ ID NO: 535740
  misc_feature: HIJSMM301DK9CS.3.71.G05.1.454.light.4.raw

SEQ ID NO: 581922 - DNA, 488 bp, Homo sapiens
  misc_feature: HIJSMM301D3SPI.9.50.E06.1.454.light.4.raw
tgatacgtctcacgaccggtgctcgatttagatctactgacaacacacaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtaggacatcaagcgaactgtggctgcaccat

SEQ ID NO: 581923 - DNA, 497 bp, Homo sapiens
  misc_feature: HIJSMM301DSB4S.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactagtggctgcacc

SEQ ID NO: 581924 - DNA, 498 bp, Homo sapiens
  misc_feature: HIJSMM301B9KE2.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcgggtctgggacagatttcactctcacaatcagcagcctgcagactgaagatgtgggcgtttattattgtcaacaatattctcttgttccgtttaatttcggcggagggccaaggtggagatcaaacgaactgtggctgcaccatctgtctcatcttcccgcat

SEQ ID NO: 581925 - DNA, 506 bp, Homo sapiens; identical to SEQ ID NO: 535404
  misc_feature: HIJSMM301CBFTT.10.88.H11.1.454.light.4.raw

SEQ ID NO: 581926 - DNA, 501 bp, Homo sapiens; identical to SEQ ID NO: 535873
  misc_feature: HIJSMM301AKPMI.17.27.C05.1.454.light.4.raw

SEQ ID NO: 581927 - DNA, 499 bp, Homo sapiens
  misc_feature: HIJSMM301BKTY5.40.80.H03.1.454.light.4.raw
tctagcgactcacgaccggtgctcgatttagctgtgcgtcgaagggaaagggggaggaactgctcagttaggacccagagggaaccatggaagccccagctcagcttctcttcctcctgctactctggctcccagataccgccggagaaattgtgttgacacagtctccagccaccctgtctttatctccaggggaaagagccatcctctcctgcagggccagtcagaatattgatacatacttagcctggtaccagcagaaacctggcctggctcccagggtcctcatccatgatgcctcccacagggccactggcatcccacacaggttcagtggcagtgggtctgggacagacttcagtctcaccatcagcagcctagagcctgaggattttgcaatttatttctgtcaacagcgtagcacctggccccgggtcaccttcggccaagggacacgactggacatgaaacgaactgtggctgcaccatctgtcttcta

SEQ ID NO: 581928 - DNA, 457 bp, Homo sapiens; identical to SEQ ID NO: 539745
  misc_feature: HIJSMM301B4Y4M.49.83.H06.1.454.light.4.raw

SEQ ID NO: 581929 - DNA, 487 bp, Homo sapiens; identical to SEQ ID NO: 541889
  misc_feature: HIJSMM301EOH4I.26.23.C01.1.454.light.4.raw

SEQ ID NO: 581930 - DNA, 473 bp, Homo sapiens
  misc_feature: HIJSMM301DNB33.49.27.C05.1.454.light.4.raw
agtcgagagacacgaccggtgctcgatttagacgcgatcgaagggtttggggcgagtcagtcccaaccaggacacagcatggacatgagggtccctgctcagctcctggggctcctgctgctctggctctcaggtgccagatgtgtcatccagatgaccccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcacgtttcggcggggggaccgaaggtggaggatcaagcgaa

SEQ ID NO: 581931 - DNA, 521 bp, Homo sapiens; identical to SEQ ID NO: 538715
  misc_feature: HIJSMM301D7O4M.27.23.C01.1.454.light.4.raw

SEQ ID NO: 581932 - DNA, 489 bp, Homo sapiens; identical to SEQ ID NO: 535139
  misc_feature: HIJSMM301DEW4J.14.55.E11.1.454.light.4.raw

SEQ ID NO: 581933 - DNA, 493 bp, Homo sapiens
  misc_feature: HIJSMM301CNLHO.41.64.F09.1.454.light.4.raw
tctatactatcacgaccggtgctcgatttagcgcgtatacaagggggaggttctttctctgggatgtggcatgagcaaaactgacaagtcaaggcaggaagatgttgccatcacaactcattgggtttctgctgctctgggttccagtctccaggggtgaaattgtgctgactcaatctccagactttcagtctgtgactccaaaggagaaagtcaccatcacctgccgggccagtcagagcattggttatagcttacactggtaccagcagaaaccagatcagcctccaaagctcctcatcaagtatgcttcccagtccatctcaggggtcccctcgaggttcagtggcagtggatctgggacagatttcaccctcaccatcaatagcctggaagctgaagatgttgcaacgtattactgtcatcagatagttacttacctcggaccttcggccgaaggacacgactggagattaaacgaactgtggctgca

SEQ ID NO: 581934 - DNA, 500 bp, Homo sapiens; identical to SEQ ID NO: 546613
  misc_feature: HIJSMM301DD2JS.11.21.B10.1.454.light.4.raw

SEQ ID NO: 581935 - DNA, 488 bp, Homo sapiens; identical to SEQ ID NO: 537260
  misc_feature: HIJSMM301DHVAX.47.70.G04.1.454.light.4.raw

SEQ ID NO: 581936 - DNA, 485 bp, Homo sapiens
  misc_feature: HIJSMM301ECCWH.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggataatcagacgaa

SEQ ID NO: 581937 - DNA, 499 bp, Homo sapiens
  misc_feature: HIJSMM301C63TN.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaagtggatatcaaacgaactgtggctgcaccatct

SEQ ID NO: 581938 - DNA, 490 bp, Homo sapiens
  misc_feature: HIJSMM301DQA2H.48.10.A10.1.454.light.4.raw
agtatacatacacgaccggtgctcgatttagcgtcgatctcaggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacaaaattcactctcaccatcagcggcctgcagtctgatgattttgcaacttatttctgccaacagtatcatacttattctcggaccttcggccaagggaccacgggtggaaagtcaaacgaacctagtggctgcaccatctgtcttcta

SEQ ID NO: 581939 - DNA, 462 bp, Homo sapiens; identical to SEQ ID NO: 569799
  misc_feature: HIJSMM301A4D0F.11.73.G07.1.454.light.4.raw

SEQ ID NO: 581940 - DNA, 484 bp, Homo sapiens; identical to SEQ ID NO: 536162
  misc_feature: HIJSMM301DZXAI.13.59.F04.1.454.light.4.raw

SEQ ID NO: 581941 - DNA, 500 bp, Homo sapiens; identical to SEQ ID NO: 575494
  misc_feature: HIJSMM301B63JP.11.67.G01.1.454.light.4.raw

SEQ ID NO: 581942 - DNA, 485 bp, Homo sapiens
  misc_feature: HIJSMM301ERY1J.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggaccagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccagggtcaccgtcctaggtcagcccaaggccaa

SEQ ID NO: 581943 - DNA, 487 bp, Homo sapiens; identical to SEQ ID NO: 536206
  misc_feature: HIJSMM301BO3TN.47.38.D05.1.454.light.4.raw

SEQ ID NO: 581944 - DNA, 505 bp, Homo sapiens
  misc_feature: HIJSMM301AEL0J.40.34.D01.1.454.light.4.raw
tctagcgactcacgaccggtgctcgatttagatcgtctgtgttgggtttggggggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccaccactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctgccccctcggt

SEQ ID NO: 581945 - DNA, 521 bp, Homo sapiens
  misc_feature: HIJSMM301DCDW4.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccacct

SEQ ID NO: 581946 - DNA, 488 bp, Homo sapiens; identical to SEQ ID NO: 567348
  misc_feature: HIJSMM301CUOQK.14.55.E11.1.454.light.4.raw

SEQ ID NO: 581947 - DNA, 504 bp, Homo sapiens; identical to SEQ ID NO: 553842
  misc_feature: HIJSMM301B5X0H.16.9.A09.1.454.light.4.raw

SEQ ID NO: 581948 - DNA, 485 bp, Homo sapiens; identical to SEQ ID NO: 539315
  misc_feature: HIJSMM301D21N2.3.88.H11.1.454.light.4.raw

SEQ ID NO: 581949 - DNA, 489 bp, Homo sapiens
  misc_feature: HIJSMM301BUYN9.8.4.A04.1.454.light.4.raw
ctcgcgtgtccacgaccggtgctcgatttagagtagtgatcagggggaaaaggccctgaggaaaacaaaccccagctgggaagcctgagaacacttagccttcatgagtgtccccaccatggcctggatgatgcttctcctcggactccttgcttatggatcaggagtggattctgagactgtggtgacccaggagccgtcgttctccgtgtcccctggagagacagtcacactcacttgtggcttgagctctggctcagtctctcgtggttactccccctcttggtaccagcagaccccaggccaggctccacgcatgctcatgtacagcacaaacattcgcacttctggggtccctgatcgcttctctggctccatccttgggaacaagctgccctcaccatcacggggcccaggcagatgatgaatctcattattactgtgcactgcatttgcgtgatgtcaattatgtgttcggcggagggaccg

SEQ ID NO: 581950 - DNA, 488 bp, Homo sapiens; identical to SEQ ID NO: 537673
  misc_feature: HIJSMM301APQ78.12.31.C09.1.454.light.4.raw

SEQ ID NO: 581951 - DNA, 489 bp, Homo sapiens; identical to SEQ ID NO: 535139
  misc_feature: HIJSMM301EGMPR.14.55.E11.1.454.light.4.raw

SEQ ID NO: 581952 - DNA, 485 bp, Homo sapiens
  misc_feature: HIJSMM301C6VUF.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagacttttggccaggggaccaagctggagatcaaacgaactgtggctgcaccat

SEQ ID NO: 581953 - DNA, 493 bp, Homo sapiens
  misc_feature: HIJSMM301CKTFN.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaggaactgtggctgcaccatctgctt

SEQ ID NO: 581954 - DNA, 511 bp, Homo sapiens
  misc_feature: HIJSMM301D8HWL.10.33.C11.1.454.light.4.raw
  modified_base (487)..(487): a, c, t, g, unknown or other
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagtattttactctcggcatccgcagcctgcagcctgaagtattttgcgacatattactgtacaacagtatagaaaatgtcccgctctaccgttcgggtcgggggacgaacggtaggagttacgaacgaactgtcggntgcacactctgtcttcacttcccg

SEQ ID NO: 581955 - DNA, 494 bp, Homo sapiens; identical to SEQ ID NO: 536463
  misc_feature: HIJSMM301DFTPV.22.57.F02.1.454.light.4.raw

SEQ ID NO: 581956 - DNA, 511 bp, Homo sapiens
  misc_feature: HIJSMM301A13P9.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaaagtcagccccaaggctgccccctcggtcactctgttcccg

SEQ ID NO: 581957 - DNA, 475 bp, Homo sapiens
  misc_feature: HIJSMM301AJ76B.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttacaaagtgggtcccatcaaggttcagcggcagtggatctgggacagatttcactctcaccatcagcagcctacagcctgaagattttgcaacttattactgtcaacagcttaataattatgcgctcactttcggcggagggaccaaggtggagatcaaacgaactgtggctgcaccat

SEQ ID NO: 581958 - DNA, 488 bp, Homo sapiens
  misc_feature: HIJSMM301CZMYY.49.81.H04.1.454.light.4.raw
agtcgagagacacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatctaccactcactttcggtcggagggaccgacggtggagatcaaacgaactagtggctgcaccatctgtt

SEQ ID NO: 581959 - DNA, 496 bp, Homo sapiens; identical to SEQ ID NO: 542070
  misc_feature: HIJSMM301B933Q.22.14.B03.1.454.light.4.raw

SEQ ID NO: 581960 - DNA, 497 bp, Homo sapiens; identical to SEQ ID NO: 536376
  misc_feature: HIJSMM301BHD92.22.9.A09.1.454.light.4.raw

SEQ ID NO: 581961 - DNA, 506 bp, Homo sapiens; identical to SEQ ID NO: 535058
  misc_feature: HIJSMM301BQ03Y.17.41.D08.1.454.light.4.raw

SEQ ID NO: 581962 - DNA, 486 bp, Homo sapiens
  misc_feature: HIJSMM301CRWSR.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttatattgtcagcaatattatattcctcctcagacgttcgccaagggaccaaggtgaaatcaaacgaactgtgg

SEQ ID NO: 581963 - DNA, 486 bp, Homo sapiens; identical to SEQ ID NO: 535043
  misc_feature: HIJSMM301DJUNQ.46.35.D02.1.454.light.4.raw

SEQ ID NO: 581964 - DNA, 493 bp, Homo sapiens; identical to SEQ ID NO: 544335
  misc_feature: HIJSMM301BK3UC.5.57.F02.1.454.light.4.raw

SEQ ID NO: 581965 - DNA, 490 bp, Homo sapiens; identical to SEQ ID NO: 543909
  misc_feature: HIJSMM301DF6NW.14.55.E11.1.454.light.4.raw

SEQ ID NO: 581966 - DNA, 480 bp, Homo sapiens; identical to SEQ ID NO: 546518
  misc_feature: HIJSMM301BR7LW.4.39.D06.1.454.light.4.raw

SEQ ID NO: 581967 - DNA, 499 bp, Homo sapiens; identical to SEQ ID NO: 543600
  misc_feature: HIJSMM301DJ2L0.14.23.C01.1.454.light.4.raw

SEQ ID NO: 581968 - DNA, 505 bp, Homo sapiens; identical to SEQ ID NO: 535503
  misc_feature: HIJSMM301EFO62.8.28.C06.1.454.light.4.raw

SEQ ID NO: 581969 - DNA, 486 bp, Homo sapiens; identical to SEQ ID NO: 536261
  misc_feature: HIJSMM301AL365.26.55.E11.1.454.light.4.raw

SEQ ID NO: 581970 - DNA, 504 bp, Homo sapiens
  misc_feature: HIJSMM301ER1DA.51.5.A05.1.454.light.4.raw
cgatcgtatacacgaccggtgctcgatttagatagatagacagggggtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcgggcggagggacgaagctgaccgtcctgagtcagcccaaggctgccccctcggtcactctcgttccccg

SEQ ID NO: 581971 - DNA, 501 bp, Homo sapiens
  misc_feature: HIJSMM301AG5EP.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccca

SEQ ID NO: 581972 - DNA, 485 bp, Homo sapiens
  misc_feature: HIJSMM301AQP9E.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttctacacttttggccaggggaccaagctggagatcaacgaa

SEQ ID NO: 581973 - DNA, 487 bp, Homo sapiens; identical to SEQ ID NO: 536536
  misc_feature: HIJSMM301DUIF8.26.45.E01.1.454.light.4.raw

SEQ ID NO: 581974 - DNA, 490 bp, Homo sapiens; identical to SEQ ID NO: 542534
  misc_feature: HIJSMM301BWTG9.16.68.G02.1.454.light.4.raw

SEQ ID NO: 581975 - DNA, 442 bp, Homo sapiens
  misc_feature: HIJSMM301C9A0V.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtattaga

SEQ ID NO: 581976 - DNA, 517 bp, Homo sapiens
  misc_feature: HIJSMM301DGTY3.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatggttgcaccgcaaagcgggacccagaccctggagcctcagttggaagcagccgatccagcctgcggagcctgtggggcaggtcagcccaaggctcgccccctcggtcactctgttcccaccctcctccacg

SEQ ID NO: 581977 - DNA, 500 bp, Homo sapiens
  misc_feature: HIJSMM301A9QGT.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttccccgccctcctccacgagagta

SEQ ID NO: 581978 - DNA, 486 bp, Homo sapiens; identical to SEQ ID NO: 535043
  misc_feature: HIJSMM301C21RK.46.35.D02.1.454.light.4.raw

SEQ ID NO: 581979 - DNA, 488 bp, Homo sapiens
  misc_feature: HIJSMM301DQTH1.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtgggatctagggcagatttcactctcaccatcaatcacctgcaggctgaggattttgcaacttactactgtcagcaggctaacaggctgcccccaacttcggccaggggacacgactggagattaaacgaactgtggctgcaccat

SEQ ID NO: 581980 - DNA, 490 bp, Homo sapiens; identical to SEQ ID NO: 577623
  misc_feature: HIJSMM301EJ4T6.49.42.D09.1.454.light.4.raw

SEQ ID NO: 581981 - DNA, 506 bp, Homo sapiens; identical to SEQ ID NO: 545686
  misc_feature: HIJSMM301C2Y8T.18.37.D04.1.454.light.4.raw

SEQ ID NO: 581982 - DNA, 487 bp, Homo sapiens; identical to SEQ ID NO: 536536
  misc_feature: HIJSMM301BWFNW.26.45.E01.1.454.light.4.raw

SEQ ID NO: 581983 - DNA, 467 bp, Homo sapiens
  misc_feature: HIJSMM301C11A6.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggaccggacccccaaactcctcatgtatgacagtagtgagcggccctcgaggggtccctgaccgattctctggctctaagtctggcacctcggcctccctggacatcagtggcctccggtccgaggatgaggctgattattactgtgcagcatgggattacaacctgagtgatcctagttgggtgttcggcgggagggaccaggctgaccgtcctaggtcacgcccaaggctcgccccctcggtcactctcgttcccaccctcctcacgcgtatgt

SEQ ID NO: 581984 - DNA, 487 bp, Homo sapiens; identical to SEQ ID NO: 546120
  misc_feature: HIJSMM301A9Q5I.43.33.C11.1.454.light.4.raw

SEQ ID NO: 581985 - DNA, 503 bp, Homo sapiens; identical to SEQ ID NO: 536313
  misc_feature: HIJSMM301AKVCJ.21.22.B11.1.454.light.4.raw

SEQ ID NO: 581986 - DNA, 513 bp, Homo sapiens; identical to SEQ ID NO: 535244
  misc_feature: HIJSMM301A0A4J.17.33.C11.1.454.light.4.raw

SEQ ID NO: 581987 - DNA, 496 bp, Homo sapiens
  misc_feature: HIJSMM301AT3DK.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaaagtggagatcaaacgaactgtggctgcaccactctgtcttt

SEQ ID NO: 581988 - DNA, 480 bp, Homo sapiens; identical to SEQ ID NO: 535291
  misc_feature: HIJSMM301BVOPN.22.59.F04.1.454.light.4.raw

SEQ ID NO: 581989 - DNA, 487 bp, Homo sapiens
  misc_feature: HIJSMM301AKFXX.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggaccaaaggtggagatcaaacgaactgtggctgcaccat

SEQ ID NO: 581990 - DNA, 504 bp, Homo sapiens
  misc_feature: HIJSMM301ERF8P.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagatttgcaacttattactgtctacaagattcttcttaccctcggacgttcggtccgacgggaccggttttacggacggtacgtgtcgaagacgaacgtacgtggtcgtgtcgacc

SEQ ID NO: 581991 - DNA, 480 bp, Homo sapiens; identical to SEQ ID NO: 535442
  misc_feature: HIJSMM301DZ3W2.41.17.B06.1.454.light.4.raw

SEQ ID NO: 581992 - DNA, 495 bp, Homo sapiens
  misc_feature: HIJSMM301DVJNE.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctcaagtctggcaacacggcctccctgaccatctctgggctccaggctgaggacgaggctgattattactgcagctcatatacaagcagcagcactcaagtcttcggaactggaccaaggtcacgtcctaggtcagcccaaggccaaccc

SEQ ID NO: 581993 - DNA, 488 bp, Homo sapiens
  misc_feature: HIJSMM301DJBRY.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacatatgatatttattctccagcgttcggccaggggaccaaggtggaagtcaagcgaactgtggctgcaccatctgtt

SEQ ID NO: 581994 - DNA, 518 bp, Homo sapiens; identical to SEQ ID NO: 580721
  misc_feature: HIJSMM301BUICE.43.59.F04.1.454.light.4.raw

SEQ ID NO: 581995 - DNA, 504 bp, Homo sapiens; identical to SEQ ID NO: 535561
  misc_feature: HIJSMM301BB7EB.4.57.F02.1.454.light.4.raw

SEQ ID NO: 581996 - DNA, 446 bp, Homo sapiens
  misc_feature: HIJSMM301CYBGD.18.9.A09.1.454.light.4.raw
  modified_base (411)..(411): a, c, t, g, unknown or other
  modified_base (428)..(428): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctagtcagcccaaggccaaccccnctgtcactctgttcccnccctcctccatactcgta

SEQ ID NO: 581997 - DNA, 490 bp, Homo sapiens; identical to SEQ ID NO: 538714
  misc_feature: HIJSMM301EJUQU.11.12.B01.1.454.light.4.raw

SEQ ID NO: 581998 - DNA, 489 bp, Homo sapiens
  misc_feature: HIJSMM301AZNV9.14.55.E11.1.454.light.4.raw
  modified_base (454)..(454): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagtacagtaccccctcacttcgtcggaggacgaagacggagagtnacacgaactagtgcgtgcaccactctcgtcttcta

SEQ ID NO: 581999 - DNA, 491 bp, Homo sapiens; identical to SEQ ID NO: 535176
  misc_feature: HIJSMM301CO3A2.13.39.D06.1.454.light.4.raw

SEQ ID NO: 582000 - DNA, 483 bp, Homo sapiens; identical to SEQ ID NO: 547440
  misc_feature: HIJSMM301CBCNQ.47.62.F07.1.454.light.4.raw

SEQ ID NO: 582001 - DNA, 454 bp, Homo sapiens; identical to SEQ ID NO: 536943
  misc_feature: HIJSMM301DIN9K.19.86.H09.1.454.light.4.raw

SEQ ID NO: 582002 - DNA, 493 bp, Homo sapiens; identical to SEQ ID NO: 544335
  misc_feature: HIJSMM301CR9CY.5.57.F02.1.454.light.4.raw

SEQ ID NO: 582003 - DNA, 515 bp, Homo sapiens
  misc_feature: HIJSMM301DBSDP.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagccaaggccaacccactgtcactctgttcccacctcctccgt

SEQ ID NO: 582004 - DNA, 497 bp, Homo sapiens; identical to SEQ ID NO: 539718
  misc_feature: HIJSMM301DHXZS.40.54.E10.1.454.light.4.raw

SEQ ID NO: 582005 - DNA, 494 bp, Homo sapiens; identical to SEQ ID NO: 542264
  misc_feature: HIJSMM301DIBUX.13.6.A06.1.454.light.4.raw

SEQ ID NO: 582006 - DNA, 516 bp, Homo sapiens
  misc_feature: HIJSMM301CJ0Z7.9.12.B01.1.454.light.4.raw
tgatacgtctcacgaccggtgctcgatttagtagtgtagattccgcggggacaacaggcaggcaggggcagcaagacggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaacggtagggaaagtacgaaaacgaaaccgtagtaggtcgtcggcaccaactctcgttcttcc

SEQ ID NO: 582007 - DNA, 510 bp, Homo sapiens
  misc_feature: HIJSMM301B7KD7.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactcgtcactctcgttccta

SEQ ID NO: 582008 - DNA, 507 bp, Homo sapiens
  misc_feature: HIJSMM301CRJTL.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattccccggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctcgccccctcggtcactctgttcccaccctcctcgctacgtaga

SEQ ID NO: 582009 - DNA, 462 bp, Homo sapiens
  misc_feature: HIJSMM301DEVF9.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagatggacatgaaacgaa

SEQ ID NO: 582010 - DNA, 505 bp, Homo sapiens
  misc_feature: HIJSMM301AKOCI.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacttcggccctgggaccaagtggatatcaaacgaactagtggctgcaccatctgtctt

SEQ ID NO: 582011 - DNA, 507 bp, Homo sapiens; identical to SEQ ID NO: 544755
  misc_feature: HIJSMM301CHLZA.11.57.F02.1.454.light.4.raw

SEQ ID NO: 582012 - DNA, 488 bp, Homo sapiens; identical to SEQ ID NO: 535125
  misc_feature: HIJSMM301BX66O.17.25.C03.1.454.light.4.raw

SEQ ID NO: 582013 - DNA, 487 bp, Homo sapiens
  misc_feature: HIJSMM301D1DBQ.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggcctagggaccaagctggagatcaaacgaa

SEQ ID NO: 582014 - DNA, 506 bp, Homo sapiens
  misc_feature: HIJSMM301BD20C.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactggaccaaggtcaccgtctacgtcagcccaaggccaacccactgtcactctgttcccacct

SEQ ID NO: 582015 - DNA, 478 bp, Homo sapiens; identical to SEQ ID NO: 535129
  misc_feature: HIJSMM301BS2QT.11.11.A11.1.454.light.4.raw

SEQ ID NO: 582016 - DNA, 488 bp, Homo sapiens; identical to SEQ ID NO: 544442
  misc_feature: HIJSMM301ELEMJ.19.57.F02.1.454.light.4.raw

SEQ ID NO: 582017 - DNA, 494 bp, Homo sapiens; identical to SEQ ID NO: 534994
  misc_feature: HIJSMM301B8ZYT.27.78.H01.1.454.light.4.raw

SEQ ID NO: 582018 - DNA, 506 bp, Homo sapiens; identical to SEQ ID NO: 534969
  misc_feature: HIJSMM301B7RJF.18.37.D04.1.454.light.4.raw

SEQ ID NO: 582019 - DNA, 508 bp, Homo sapiens; identical to SEQ ID NO: 540739
  misc_feature: HIJSMM301DZX7B.14.7.A07.1.454.light.4.raw

SEQ ID NO: 582020 - DNA, 460 bp, Homo sapiens; identical to SEQ ID NO: 539553
  misc_feature: HIJSMM301CENAS.11.86.H09.1.454.light.4.raw

SEQ ID NO: 582021 - DNA, 504 bp, Homo sapiens; identical to SEQ ID NO: 549538
  misc_feature: HIJSMM301A7BT4.18.59.F04.1.454.light.4.raw

SEQ ID NO: 582022 - DNA, 490 bp, Homo sapiens; identical to SEQ ID NO: 535234
  misc_feature: HIJSMM301BJE6R.17.21.B10.1.454.light.4.raw

SEQ ID NO: 582023 - DNA, 500 bp, Homo sapiens
  misc_feature: HIJSMM301D9OPX.21.81.H04.1.454.light.4.raw
tcgtcgctcgcacgaccggtgctcgatttagtagtgtagattcgcgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcacgtcctaggtcagcccaaggccaacccactgtcta

SEQ ID NO: 582024 - DNA, 500 bp, Homo sapiens
  misc_feature: HIJSMM301C37PI.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttattactgccaacattataatacttattcgtacacttttggccagggaccaagctggagatcaaacgaaactgtggctgcaccatctgtcttcatcttcccgcca

SEQ ID NO: 582025 - DNA, 503 bp, Homo sapiens; identical to SEQ ID NO: 567708
  misc_feature: HIJSMM301BW5GC.21.81.H04.1.454.light.4.raw

SEQ ID NO: 582026 - DNA, 476 bp, Homo sapiens
  misc_feature: HIJSMM301C73J7.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatccagcgggacccaggctatggatgaggctgactattactgtcaggctgggacagcagcactgcccgctatgtcttcggaactgggaccaaggtcaccgtcctaagtcagaccccg

SEQ ID NO: 582027 - DNA, 485 bp, Homo sapiens; identical to SEQ ID NO: 535501
  misc_feature: HIJSMM301B74A3.3.10.A10.1.454.light.4.raw

SEQ ID NO: 582028 - DNA, 494 bp, Homo sapiens
  misc_feature: HIJSMM301A79RH.48.55.E11.1.454.light.4.raw
agtatacatacacgaccggtgctcgatttagcactcgcacgttgggtttgggggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtata

SEQ ID NO: 582029 - DNA, 491 bp, Homo sapiens
  misc_feature: HIJSMM301BZPXY.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatcttcccgcta

SEQ ID NO: 582030 - DNA, 503 bp, Homo sapiens; identical to SEQ ID NO: 535140
  misc_feature: HIJSMM301ELCXZ.18.37.D04.1.454.light.4.raw

SEQ ID NO: 582031 - DNA, 485 bp, Homo sapiens
  misc_feature: HIJSMM301DL079.14.55.E11.1.454.light.4.raw
cgtctagtaccacgaccggtgctcgatttagcactcgcacgttggggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagccctgacctctgatctatgctgcatccagtttgcacagtggggtcccgtcaaggttcagtggcagtggatctgggacagatttcactctcaccgtcagcagtctgcaacttgaagattttgcaacttactactgtcaacagagttacagtaccccctcacttcggcggagggaccaaggcggagatcagacgaactgtggctgcacatctgtcttcta

SEQ ID NO: 582032 - DNA, 488 bp, Homo sapiens
  misc_feature: HIJSMM301D8M7S.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaaggtggagatcaaacgaactgtggctgcaccta

SEQ ID NO: 582033 - DNA, 494 bp, Homo sapiens; identical to SEQ ID NO: 543242
  misc_feature: HIJSMM301CL63N.27.78.H01.1.454.light.4.raw
  modified_base (462)..(462): a, c, t, g, unknown or other

SEQ ID NO: 582034 - DNA, 495 bp, Homo sapiens
  misc_feature: HIJSMM301A2G8Y.52.3.A03.1.454.light.4.raw
cgcagtacgacacgaccggtgctcgatttagagagcgtcacaggggggagtcagacccagtcaggacacagcatggacatgagggtccccgctcagctcctggggctcctgctgctctggctcccaggtgccaaatgtgacatccagatgacccagtctccttccaccctgtctgcatctgttggagacagagtcaccatctcttgccgggccagtcagagtattagtacctcgttggcctggtatcagaagaaaccagggaaacgcccctaaactcctgatctctaaggcatctgatttacaaacgtggggtcccgtcaaggttcagcggcagtggatctgggacagacttcactctcaccatcagcagcctgcagcctgatgactttgctaagttattattgaccaacagtataactagtttttcatttcacttttggccctgggacgacagtggatatacaaacgaactgtggctgcaccatctgtcttcta

SEQ ID NO: 582035 - DNA, 485 bp, Homo sapiens; identical to SEQ ID NO: 535880
  misc_feature: HIJSMM301CUREF.7.75.G09.1.454.light.4.raw

SEQ ID NO: 582036 - DNA, 497 bp, Homo sapiens; identical to SEQ ID NO: 545672
  misc_feature: HIJSMM301A4XVO.2.49.E05.1.454.light.4.raw

SEQ ID NO: 582037 - DNA, 506 bp, Homo sapiens
  misc_feature: HIJSMM301BCLHX.40.33.C11.1.454.light.4.raw
tctagcgactcacgaccggtgctcgatttagagtgagctcgttgggtttggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccagttacgggggcccagccagaggatgagtcttattattactgcatgctccatggtgggggtgccacttgggtgttcggcggagggaccaagctgaccgtcctaggtcagcccaaggctcgccccctcc

SEQ ID NO: 582038 - DNA, 496 bp, Homo sapiens
  misc_feature: HIJSMM301DHWY0.51.39.D06.1.454.light.4.raw
cgatcgtatacacgaccggtgctcgatttagtgacatctcgcagttctttggggggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccactcagggacactggtcacattgaccatcagtggagtccaggcagaagacgaggctgactatttctgtcaatcttcagacgtcagtggtacttatgtcttcggaactgggaccaaggtcaccgtcctaggtcagcccaaggccaacccactgtcactctcg

SEQ ID NO: 582039 - DNA, 501 bp, Homo sapiens
  misc_feature: HIJSMM301BJ3MB.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttattactgtcagcaatatttttctatcctccgtggacgttcggccaagggccagggtggaaatcagacgaactgtgctgcaccat

SEQ ID NO: 582040 - DNA, 475 bp, Homo sapiens
  misc_feature: HIJSMM301DE07P.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaacttactactgtcaacagagtttcagtatcccttggactttcggccaagggaccaaggtggaaatacaaacgaa

SEQ ID NO: 582041 - DNA, 478 bp, Homo sapiens
  misc_feature: HIJSMM301A27CV.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttggggtttattacgtgcatgcaagctctacaaaccctattcactttcgccctgggaccagacgtggata

SEQ ID NO: 582042 - DNA, 485 bp, Homo sapiens
  misc_feature: HIJSMM301AST1I.15.1.A01.1.454.light.4.raw
tctacgtagccacgaccggtgctcgatttagacgtctcatcagggcctgggctctgctgctcctcactctcctcactcaggacacggggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccaccctcctcgctacgtaga

SEQ ID NO: 582043 - DNA, 488 bp, Homo sapiens
  misc_feature: HIJSMM301AZ0WA.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatctttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggatatcagacgaa

SEQ ID NO: 582044 - DNA, 486 bp, Homo sapiens; identical to SEQ ID NO: 536329
  misc_feature: HIJSMM301AI5Y0.21.4.A04.1.454.light.4.raw

SEQ ID NO: 582045 - DNA, 447 bp, Homo sapiens; identical to SEQ ID NO: 535201
  misc_feature: HIJSMM301DFKF2.18.9.A09.1.454.light.4.raw

SEQ ID NO: 582046 - DNA, 488 bp, Homo sapiens; identical to SEQ ID NO: 537260
  misc_feature: HIJSMM301EUR0K.47.70.G04.1.454.light.4.raw

SEQ ID NO: 582047 - DNA, 494 bp, Homo sapiens; identical to SEQ ID NO: 558792
  misc_feature: HIJSMM301DFBMH.10.79.H02.1.454.light.4.raw

SEQ ID NO: 582048 - DNA, 494 bp, Homo sapiens; identical to SEQ ID NO: 557656
  misc_feature: HIJSMM301CJ5CB.22.5.A05.1.454.light.4.raw

SEQ ID NO: 582049 - DNA, 478 bp, Homo sapiens
  misc_feature: HIJSMM301C95E7.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttgctgttcggcggcggac

SEQ ID NO: 582050 - DNA, 501 bp, Homo sapiens; identical to SEQ ID NO: 538461
  misc_feature: HIJSMM301BPEDP.13.11.A11.1.454.light.4.raw

SEQ ID NO: 582051 - DNA, 444 bp, Homo sapiens
  misc_feature: HIJSMM301EJ7KT.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactatgttcccaccctcctccgtgtctgat

SEQ ID NO: 582052 - DNA, 494 bp, Homo sapiens
  misc_feature: HIJSMM301CXNMR.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtactttcgggttttcggcggagggaccaagctgaccgtctaggtcagccaaggctgccccctcggt

SEQ ID NO: 582053 - DNA, 507 bp, Homo sapiens
  misc_feature: HIJSMM301AS2UT.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctccgctacgtaga

SEQ ID NO: 582054 - DNA, 495 bp, Homo sapiens
  misc_feature: HIJSMM301ALFRE.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggctagtttattactgtcagcagtattatactactcctctgacgttcggccaagggaccaaggtggagatacaaacgaactgtggctgcacat

SEQ ID NO: 582055 - DNA, 497 bp, Homo sapiens; identical to SEQ ID NO: 536371
  misc_feature: HIJSMM301B9JCO.16.78.H01.1.454.light.4.raw

SEQ ID NO: 582056 - DNA, 510 bp, Homo sapiens; identical to SEQ ID NO: 545115
  misc_feature: HIJSMM301CNDAL.19.59.F04.1.454.light.4.raw

SEQ ID NO: 582057 - DNA, 496 bp, Homo sapiens
  misc_feature: HIJSMM301AIAJQ.51.12.B01.1.454.light.4.raw
cgatcgtatacacgaccggtgctcgatttagtagtgtagattccgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggacttatgtcttcggaactgcgaccaaggtcaccgtcctgggtcagcccaaggccaaccccactgtcactctcg

SEQ ID NO: 582058 - DNA, 454 bp, Homo sapiens; identical to SEQ ID NO: 534964
  misc_feature: HIJSMM301A3TFI.19.86.H09.1.454.light.4.raw

SEQ ID NO: 582059 - DNA, 511 bp, Homo sapiens
  misc_feature: HIJSMM301BIVJD.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccgaaggaccgaacggtaggaagtacaagacgaactagtggcgtgcaccactctgtcttctatcttcccgt

SEQ ID NO: 582060 - DNA, 486 bp, Homo sapiens; identical to SEQ ID NO: 535385
  misc_feature: HIJSMM301B5OPP.19.71.G05.1.454.light.4.raw

SEQ ID NO: 582061 - DNA, 506 bp, Homo sapiens
  misc_feature: HIJSMM301BO7GS.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccacttcggccctcgggaccaagtggatatcaaacgaactagtggctgcaccatctgtctt

SEQ ID NO: 582062 - DNA, 492 bp, Homo sapiens; identical to SEQ ID NO: 570842
  misc_feature: HIJSMM301D6156.22.65.F10.1.454.light.4.raw

SEQ ID NO: 582063 - DNA, 492 bp, Homo sapiens; identical to SEQ ID NO: 534967
  misc_feature: HIJSMM301DB3KH.47.64.F09.1.454.light.4.raw

SEQ ID NO: 582064 - DNA, 505 bp, Homo sapiens
  misc_feature: HIJSMM301BHMMU.10.27.C05.1.454.light.4.raw
catagtagtgcacgaccggtgctcgatttagacgcgatcgaagggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgcccctcggt

SEQ ID NO: 582065 - DNA, 500 bp, Homo sapiens; identical to SEQ ID NO: 546613
  misc_feature: HIJSMM301CZPX1.11.21.B10.1.454.light.4.raw

SEQ ID NO: 582066 - DNA, 495 bp, Homo sapiens; identical to SEQ ID NO: 538651
  misc_feature: HIJSMM301AWE47.10.79.H02.1.454.light.4.raw

SEQ ID NO: 582067 - DNA, 485 bp, Homo sapiens; identical to SEQ ID NO: 536263
  misc_feature: HIJSMM301AXYP8.47.78.H01.1.454.light.4.raw

SEQ ID NO: 582068 - DNA, 494 bp, Homo sapiens; identical to SEQ ID NO: 549057
  misc_feature: HIJSMM301DCQU0.10.33.C11.1.454.light.4.raw

SEQ ID NO: 582069 - DNA, 485 bp, Homo sapiens; identical to SEQ ID NO: 538956
  misc_feature: HIJSMM301BE5IR.40.69.G03.1.454.light.4.raw

SEQ ID NO: 582070 - DNA, 509 bp, Homo sapiens
  misc_feature: HIJSMM301DTRF6.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaaacagactgcagcctgaaagatattgcagtttactactgtcagcagtatgttacgtccccgtggacgttcgcaacggaccaaggtggcaatcaaccgaactgtggctgcaccatctgtcttc

SEQ ID NO: 582071 - DNA, 496 bp, Homo sapiens; identical to SEQ ID NO: 537925
  misc_feature: HIJSMM301AFXKY.22.14.B03.1.454.light.4.raw

SEQ ID NO: 582072 - DNA, 464 bp, Homo sapiens
  misc_feature: HIJSMM301CD6OZ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggcctcgccccctcggtcactctcgttccccgccctcctcacgcgtatgt

SEQ ID NO: 582073 - DNA, 501 bp, Homo sapiens
  misc_feature: HIJSMM301DMFOF.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggtccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgcccctc

SEQ ID NO: 582074 - DNA, 500 bp, Homo sapiens
  misc_feature: HIJSMM301A81PD.51.9.A09.1.454.light.4.raw
cgatcgtatacacgaccggtgctcgatttagcgagacgcgcagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataatgtggactggtgccagcagagaccagggaagggcccccggtttgtgatgcgagtgggcactggtgggattgtgggatccaagggggatggcgtccctgatcgcttctcagtcttgggctcaggcctgaatcggaacctgaccatgaagaacatccaggaagagggtgagagtaactaccactgtggggcagaccttggcagtgggggaaacctcgtgtgaagtgtgctttcggcggagggaccaagctgaccgtcctaggtcacg

SEQ ID NO: 582075 - DNA, 515 bp, Homo sapiens
  misc_feature: HIJSMM301CQ7ZX.9.12.B01.1.454.light.4.raw
  modified_base (485)..(485): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgttcaacagttttctcgggcgtgtcgacggacgaacggaggaaagacgaaacgaaacaacgtaggtgcgngaccaactacctgtcttctactcttccccg

SEQ ID NO: 582076 - DNA, 503 bp, Homo sapiens
  misc_feature: HIJSMM301CL7UK.4.39.D06.1.454.light.4.raw
agcactgtagcacgaccggtgctcgatttagtgacatctcgcagttctttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcgg

SEQ ID NO: 582077 - DNA, 515 bp, Homo sapiens
  misc_feature: HIJSMM301A1M1O.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgctgaggacgaggctcattattactgcagctcatatacacccaggggcactctcgtgatattcgtcggacgggacggtacggtcggtcgtacggtacccgttacccgttaccgtacgaccgaacccc

SEQ ID NO: 582078 - DNA, 489 bp, Homo sapiens
  misc_feature: HIJSMM301AOQHA.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccgaaggtggagatacaaacgaactgtggctgcaccat

SEQ ID NO: 582079 - DNA, 522 bp, Homo sapiens
  misc_feature: HIJSMM301CNNGA.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccgccct

SEQ ID NO: 582080 - DNA, 501 bp, Homo sapiens; identical to SEQ ID NO: 565739
  misc_feature: HIJSMM301AXD2S.14.3.A03.1.454.light.4.raw

SEQ ID NO: 582081 - DNA, 447 bp, Homo sapiens; identical to SEQ ID NO: 535020
  misc_feature: HIJSMM301BKF28.18.9.A09.1.454.light.4.raw

SEQ ID NO: 582082 - DNA, 504 bp, Homo sapiens
  misc_feature: HIJSMM301A0RS8.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctgccccctcggtcactctgttccaccctcctccgtgt

SEQ ID NO: 582083 - DNA, 516 bp, Homo sapiens; identical to SEQ ID NO: 538293
  misc_feature: HIJSMM301BYYIG.14.19.B08.1.454.light.4.raw

SEQ ID NO: 582084 - DNA, 502 bp, Homo sapiens
  misc_feature: HIJSMM301CZDU6.2.71.G05.1.454.light.4.raw
acgctcgacacacgaccggtgctcgatttagtgtcgtcgcaagagagagggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccgaagctgaccgtcctacgtcagccaagctgcccctcggtcact

SEQ ID NO: 582085 - DNA, 494 bp, Homo sapiens; identical to SEQ ID NO: 534992
  misc_feature: HIJSMM301ENWOG.9.1.A01.1.454.light.4.raw

SEQ ID NO: 582086 - DNA, 483 bp, Homo sapiens
  misc_feature: HIJSMM301D6UM4.48.28.C06.1.454.light.4.raw
agtatacatacacgaccggtgctcgatttagagctcacgtattgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccaagctgaccgtcctaagtcagcccaaggccg

SEQ ID NO: 582087 - DNA, 501 bp, Homo sapiens
  misc_feature: HIJSMM301AGLJO.51.14.B03.1.454.light.4.raw
cgatcgtatacacgaccggtgctcgatttagtgtgagtagttccgcgggggcaggagtcagaccccgtcaggacacagcatggacatgagggtccccgctcagctcctggggctcctgctgctctggttcccaggttccagatgcgacatccagatgacccagtctccatcctccgtgtctgcatctgtaggagacagagtcaccatgacttgtcgggcgagtcagggtattgacgactacttagcctggcttcagcagaaaccagggaaagcccccaagctcttgatctatgctgcatccaggttggaaagtggggtcccatcaaggttcagcggcagtggatctgggacagatttcactctcaccatcagcagcctgcagcctgaagattttgcaacttattattgtcaacaggctaaaagttaccctactcacttcggtcggagggacgaaggtaagaaaccaaacgaaactagtggcgtgcaccatactgtcttcta

SEQ ID NO: 582088 - DNA, 505 bp, Homo sapiens; identical to SEQ ID NO: 535503
  misc_feature: HIJSMM301EMURN.8.28.C06.1.454.light.4.raw

SEQ ID NO: 582089 - DNA, 503 bp, Homo sapiens; identical to SEQ ID NO: 536834
  misc_feature: HIJSMM301BSSUT.2.35.D02.1.454.light.4.raw

SEQ ID NO: 582090 - DNA, 473 bp, Homo sapiens
  misc_feature: HIJSMM301BAX8C.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactgggaccaaggtcacgtccaagtcagccc

SEQ ID NO: 582091 - DNA, 495 bp, Homo sapiens; identical to SEQ ID NO: 559417
  misc_feature: HIJSMM301C8GT2.26.12.B01.1.454.light.4.raw

SEQ ID NO: 582092 - DNA, 489 bp, Homo sapiens; identical to SEQ ID NO: 535139
  misc_feature: HIJSMM301A0GK7.14.55.E11.1.454.light.4.raw

SEQ ID NO: 582093 - DNA, 496 bp, Homo sapiens
  misc_feature: HIJSMM301C2GJE.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaaagctgaccgtcctaggtcagcccaaggctgccccctcggtcactctgttcccaccctcctcgagtgcgct

SEQ ID NO: 582094 - DNA, 495 bp, Homo sapiens
  misc_feature: HIJSMM301AVAHM.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttccaccctcctcgagtgcgtct

SEQ ID NO: 582095 - DNA, 499 bp, Homo sapiens
  misc_feature: HIJSMM301ANTH8.52.30.C08.1.454.light.4.raw
cgcagtacgacacgaccggtgctcgatttagtctgacgtcaaagggaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactcgtcta

SEQ ID NO: 582096 - DNA, 503 bp, Homo sapiens; identical to SEQ ID NO: 571314
  misc_feature: HIJSMM301AS5EF.18.26.C04.1.454.light.4.raw

SEQ ID NO: 582097 - DNA, 487 bp, Homo sapiens
  misc_feature: HIJSMM301DA0JC.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagattttgcaacttattactgtctacaagatcacaattatcctgggacgttcggccaagggaccaaggtggaaatcaaacgaactgtggctgcaccatctgtcttcta

SEQ ID NO: 582098 - DNA, 481 bp, Homo sapiens
  misc_feature: HIJSMM301CKK4C.51.70.G04.1.454.light.4.raw
cgatcgtatacacgaccggtgctcgatttagtgtagtgtgaagggaaaggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcgggacagggtatgatgtacactggtaccagcagcttccaggaacagcccccaaactcctcatttattctaacacccatcggccctcagggtccctgatcgattctctggctccaagtctggcacctcagcctccctggccatcactggactccaggctgaggatgaggctgattattactgccagtcctatgacatcagcctgagtggttcgtgggtattcggcggagggaccagga

SEQ ID NO: 582099 - DNA, 506 bp, Homo sapiens
  misc_feature: HIJSMM301AWUYY.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtcccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactcgtcactctgttccccg

SEQ ID NO: 582100 - DNA, 480 bp, Homo sapiens
  misc_feature: HIJSMM301COTQU.4.54.E10.1.454.light.4.raw
agcactgtagcacgaccggtgctcgatttagatcgtagcagaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctactttttttaagttggtatcagcagacaccagggaaagcccctaagctcctgatctatgctgcttccagtttgcaaagtggggtcccatcaaggttcagtggcagtggatctgggacagatttcactctcactgtcagcagtctgcaatttgaagtattttgctaaactttactactgtcaacagtagttttcagttatcccttggactttcggccaagggaccaaggtggaaatcaaacgaa

SEQ ID NO: 582101 - DNA, 520 bp, Homo sapiens; identical to SEQ ID NO: 555736
  misc_feature: HIJSMM301D81VC.5.27.C05.1.454.light.4.raw

SEQ ID NO: 582102 - DNA, 444 bp, Homo sapiens; identical to SEQ ID NO: 535042
  misc_feature: HIJSMM301AYL47.10.76.G10.1.454.light.4.raw

SEQ ID NO: 582103 - DNA, 462 bp, Homo sapiens; identical to SEQ ID NO: 551148
  misc_feature: HIJSMM301A5Z5V.10.9.A09.1.454.light.4.raw

SEQ ID NO: 582104 - DNA, 500 bp, Homo sapiens; identical to SEQ ID NO: 563448
  misc_feature: HIJSMM301AZORG.22.27.C05.1.454.light.4.raw

SEQ ID NO: 582105 - DNA, 476 bp, Homo sapiens; identical to SEQ ID NO: 561673
  misc_feature: HIJSMM301CB8TS.4.32.C10.1.454.light.4.raw

SEQ ID NO: 582106 - DNA, 490 bp, Homo sapiens; identical to SEQ ID NO: 536909
  misc_feature: HIJSMM301CCVZN.12.27.C05.1.454.light.4.raw

SEQ ID NO: 582107 - DNA, 495 bp, Homo sapiens
  misc_feature: HIJSMM301DZRUP.3.35.D02.1.454.light.4.raw
agacgcactccacgaccggtgctcgatttagcacacgatagttgggtttgggggaggaactgctcagttaggacccagacggaaccatggaagccccagcgcagcttctcttcctcctgctactctggctcccagataccattggagaaagagtgatgacgcagtctccagccaccctgtctgtgtctccaggggaaagcgccactctctcctgcagggacagtcagactgttagcaccaacttagcctggtatcagcagaaacctggccagtctcccaggctcctcatctatggtgcatccaccagggcccctggtgtcccagccaggttcagtggcagtgggtctgggacagagttcactctcaccatcagcggcctgcagtctgaagattttgcagtttattactgtcagcagtataattactggccgccgacgttcggccaagggaccaaggtggaatcaaacgaactgtggctgcaccatctgtcttcta

SEQ ID NO: 582108 - DNA, 513 bp, Homo sapiens
  misc_feature: HIJSMM301BZ0BF.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggcgactattactgtcaggtgtggaatggtgattatgattatgtcttcggaactgggaccaaggtcaccgtcctaggtcagcccaaggccaacccactgtcactctgttcccaccctcctccgt

SEQ ID NO: 582109 - DNA, 487 bp, Homo sapiens; identical to SEQ ID NO: 539157
  misc_feature: HIJSMM301AEBSV.26.37.D04.1.454.light.4.raw

SEQ ID NO: 582110 - DNA, 509 bp, Homo sapiens
  misc_feature: HIJSMM301AHMUK.51.86.H09.1.454.light.4.raw
cgatcgtatacacgaccggtgctcgatttagtgctatagacttgggtttggggctgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaaactagtggctgcaccatctgtctt

SEQ ID NO: 582111 - DNA, 507 bp, Homo sapiens; identical to SEQ ID NO: 536226
  misc_feature: HIJSMM301A1Y6I.18.37.D04.1.454.light.4.raw

SEQ ID NO: 582112 - DNA, 497 bp, Homo sapiens
  misc_feature: HIJSMM301CM6RA.43.9.A09.1.454.light.4.raw
tgtgagtagtcacgaccggtgctcgatttagcgagacgcgcagggcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcagggaccaagttgaacata

SEQ ID NO: 582113 - DNA, 503 bp, Homo sapiens
  misc_feature: HIJSMM301CXLFF.48.71.G05.1.454.light.4.raw
agtatacatacacgaccggtgctcgatttagtgtcgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaacctggccagcctcccaggctcctcatctatggtgcgtccaccagggccactggcatcccagacaggttcagtggcagtgggtctgggacagacttcactctcaccatcaccagactggagcctgatgattttgcagtgtttttctgtcagcagtatggaagttcacctcggacattcggccaggggaccaaggtggaaatcaaacgaactgtggctgcaccatctgtcttcatcttcccg

SEQ ID NO: 582114 - DNA, 485 bp, Homo sapiens
  misc_feature: HIJSMM301D8ZT5.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgttgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgt

SEQ ID NO: 582115 - DNA, 506 bp, Homo sapiens; identical to SEQ ID NO: 557726
  misc_feature: HIJSMM301A76CO.47.83.H06.1.454.light.4.raw

SEQ ID NO: 582116 - DNA, 514 bp, Homo sapiens
  misc_feature: HIJSMM301DESE9.48.66.F11.1.454.light.4.raw
agtatacatacacgaccggtgctcgatttagtcacgcgagaaagggggggaagcctgagaacacttagccttcatgagtgtccccaccatggcctggatgatgcttctcctcggactccttgcttatggatcaggcgtgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggtttctggctccatcgttgggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctcggtcactctgttcccta

SEQ ID NO: 582117 - DNA, 490 bp, Homo sapiens; identical to SEQ ID NO: 542820
  misc_feature: HIJSMM301BF0AD.11.12.B01.1.454.light.4.raw

SEQ ID NO: 582118 - DNA, 484 bp, Homo sapiens
  misc_feature: HIJSMM301BB2RT.52.77.G11.1.454.light.4.raw
cgcagtacgacacgaccggtgctcgatttagctagtcactcaagggaaaggggagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccaaggtggagatcaaacgaactagtggctgcaccatctgtt

SEQ ID NO: 582119 - DNA, 483 bp, Homo sapiens; identical to SEQ ID NO: 567047
  misc_feature: HIJSMM301EKBX2.47.60.F05.1.454.light.4.raw

SEQ ID NO: 582120 - DNA, 507 bp, Homo sapiens
  misc_feature: HIJSMM301D68RU.48.5.A05.1.454.light.4.raw
agtatacatacacgaccggtgctcgatttagatagatagacagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgatgcaagtcgggccagaggtgcccctgaacctgaaggccaatgagacccaagacaggccaagtgggttgcgagacccctgaggagctgggccctggtcccaggcagcgctggcccctgctgctgctgggtctggccatggtcgcccatggcctgctgcgcccaatggttgcaccgcaaagcggggacccagaccctggagcctcagttgaaagcagccgatccagcctgcggagcctgtgggcaggtcagcccaaggccaacccactgtcactctcg

SEQ ID NO: 582121 - DNA, 499 bp, Homo sapiens
  misc_feature: HIJSMM301ARYDY.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccggggaatccggggtccctgacccgattcagtggcagcgggtctgggacagatttcactctcaccatcagcagcctgcaggctgaagatgtggcagtttattattgtcaacaatattattatacttcgtggacgttcggccaagggaccgaaggtggatatcagacgaactgtggctgca

SEQ ID NO: 582122 - DNA, 495 bp, Homo sapiens; identical to SEQ ID NO: 535821
  misc_feature: HIJSMM301C9191.3.31.C09.1.454.light.4.raw

SEQ ID NO: 582123 - DNA, 486 bp, Homo sapiens
  misc_feature: HIJSMM301E05AJ.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagatttttacactgaaaatcagccgggtggaggctgaggacgttggaatttattactgtatgcaaggtatagagcttcctccgacgttcggccaagggaccaaggtggaactcaaacgaactgtggctgcaccaatctgtcttcatcttcccgccatctgactagtctacg

SEQ ID NO: 582124 - DNA, 441 bp, Homo sapiens; identical to SEQ ID NO: 534971
  misc_feature: HIJSMM301C911L.11.3.A03.1.454.light.4.raw

SEQ ID NO: 582125 - DNA, 481 bp, Homo sapiens; identical to SEQ ID NO: 535993
  misc_feature: HIJSMM301DL8Y8.21.25.C03.1.454.light.4.raw

SEQ ID NO: 582126 - DNA, 476 bp, Homo sapiens
  misc_feature: HIJSMM301DVN7G.13.76.G10.1.454.light.4.raw
tcacgtactacacgaccggtgctcgatttagtcactcatacagggggaggctctgcttcagctgtgggcacaagaggcagcactcaggacaatctccagcatggcctggtctcctctcctcctcactctcctcgctcactgcacagggtcctgggcccagtctgtactgacgcagccgccctcagtgtctggggccccagggcagagggtcaccatctcctgcactgggagcagctccaacattggggcacattatgatgtacactggtaccagcagtttccaggagcaggtcccagactcctcatcaatagtaacaacaatcggcccgcaggggtccctgaccgattctctggctccaggtctggcacctcagcctccctggtcatcactgggctccaggctgaggatgaggctgattatttctgccagtcctatgacagcagcctgagtgcttcggtattcggcggggggaccc

SEQ ID NO: 582127 - DNA, 480 bp, Homo sapiens; identical to SEQ ID NO: 557152
  misc_feature: HIJSMM301DDNGI.8.12.B01.1.454.light.4.raw

SEQ ID NO: 582128 - DNA, 486 bp, Homo sapiens; identical to SEQ ID NO: 544134
  misc_feature: HIJSMM301ELXEO.17.26.C04.1.454.light.4.raw

SEQ ID NO: 582129 - DNA, 485 bp, Homo sapiens
  misc_feature: HIJSMM301A2ZIZ.52.41.D08.1.454.light.4.raw
cgcagtacgacacgaccggtgctcgatttagtcacgcgagaaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactatttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaactagacgataatctcccgctcactttcggcgggggaccgaaggtggagatcaaacgaactagtggctgcaccat

SEQ ID NO: 582130 - DNA, 496 bp, Homo sapiens; identical to SEQ ID NO: 535612
  misc_feature: HIJSMM301A2SGL.22.9.A09.1.454.light.4.raw

SEQ ID NO: 582131 - DNA, 480 bp, Homo sapiens; identical to SEQ ID NO: 557916
  misc_feature: HIJSMM301BEWMW.51.76.G10.1.454.light.4.raw

SEQ ID NO: 582132 - DNA, 517 bp, Homo sapiens
  misc_feature: HIJSMM301ANHO9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaagggaccgaacggtaggaaggtacaaacgaacctagtggcgtgcaccactctgtcttctatcttcccgtccact

SEQ ID NO: 582133 - DNA, 484 bp, Homo sapiens
  misc_feature: HIJSMM301DSOCC.19.5.A05.1.454.light.4.raw
tactctcgtgcacgaccggtgctcgatttagatagatagacaggcaggggcagcaagatggtgttgcagacccaggtcttcatttctctgttgctctggatctctggtgccttcggggacatcgtgctgacccagtctccagacacactggctgtgtctctgggcgagagggccaccatcaactgcaggtccagcgagagtattttgtacagacccaacagtaagaactacttggcttggtatcagcagaaaccaggacagcctcctaaactgctcatttattgggcatctacccgggaaattggggtccctgtccgattcagcggcagcgtgtctgggacagatttcactctcaccatcagcagcctgcaggctgaagatgtggcggtctattactgtcaacaatattatgaaagtccagggactttcggccctgggactaaggtggagatcagacgaactgtggctgcacatctgtcttcta

SEQ ID NO: 582134 - DNA, 495 bp, Homo sapiens; identical to SEQ ID NO: 538269
  misc_feature: HIJSMM301AM525.9.1.A01.1.454.light.4.raw

SEQ ID NO: 582135 - DNA, 509 bp, Homo sapiens; identical to SEQ ID NO: 535670
  misc_feature: HIJSMM301A51WW.47.23.C01.1.454.light.4.raw

SEQ ID NO: 582136 - DNA, 483 bp, Homo sapiens; identical to SEQ ID NO: 535413
  misc_feature: HIJSMM301ASOO3.26.78.H01.1.454.light.4.raw

SEQ ID NO: 582137 - DNA, 502 bp, Homo sapiens
  misc_feature: HIJSMM301CY2C8.3.70.G04.1.454.light.4.raw
agacgcactccacgaccggtgctcgatttagtgtagtgtgaagggaaaggggaggaactgctcagttaggacccagagggaaccatggaagccccagctcagcttctcttcctcctgctactctggctcccagataacaccggacaaactgtgttgacacagtctccagccaccctgtctttgtccccaggggagacagccaccctctcctgcagggccagtcagagtgttaggggccacttagcctggtaccagcagaaacctggccagcctcccagtctcctcatctatggagcacacaacagggccactggcatcccagccaggttcagtggcagtgggtctgggacagacttcaccctcatcatcagccgcctagagcctgaagattttgcagtttattactgtcagcagggttacttctggcccactttcggccctgggaccaaagtggatatcaaacgaactgtggctgcaccatctgtcttcatcttcccgccat

SEQ ID NO: 582138 - DNA, 506 bp, Homo sapiens; identical to SEQ ID NO: 534969
  misc_feature: HIJSMM301EQ26M.18.37.D04.1.454.light.4.raw

SEQ ID NO: 582139 - DNA, 498 bp, Homo sapiens
  misc_feature: HIJSMM301DTYUL.49.38.D05.1.454.light.4.raw
agtcgagagacacgaccggtgctcgatttagtatctgatagttgggtttggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctgcaagcaggtccaatattgcgaatgagtatgtttcctggtaccagcacctcccaggaacagtccccaaactcctcatttatgacaataataggcgaccctcagggattcctgaccgattctctggctccaagtctgccgcgtcagccaccctgggcatcaccggactccagactggggacgagggcgattattactgcgcaataggggatagaagtctgagtgctggcagggtgttcggcggagggaccaagctgaccgtcctaggtcacg

SEQ ID NO: 582140 - DNA, 489 bp, Homo sapiens; identical to SEQ ID NO: 549568
  misc_feature: HIJSMM301A9BEU.43.33.C11.1.454.light.4.raw

SEQ ID NO: 582141 - DNA, 495 bp, Homo sapiens
  misc_feature: HIJSMM301AT0HF.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggtttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccg

SEQ ID NO: 582142 - DNA, 484 bp, Homo sapiens
  misc_feature: HIJSMM301B0P7Z.17.26.C04.1.454.light.4.raw
cgtagactagcacgaccggtgctcgatttagtctagcgactttgggtttgggggtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagatttgcaacttactactgttcaacagagttacaatacccctcggctcactttcggcggagggaccaaggtggagagtcaaacgaactgtggctgcacc

SEQ ID NO: 582143 - DNA, 507 bp, Homo sapiens
  misc_feature: HIJSMM301E0MM4.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccgaaagtaggatatcaaacgaactagtggctgcaccatctgtt

SEQ ID NO: 582144 - DNA, 494 bp, Homo sapiens; identical to SEQ ID NO: 534992
  misc_feature: HIJSMM301CUYJV.9.1.A01.1.454.light.4.raw

SEQ ID NO: 582145 - DNA, 486 bp, Homo sapiens
  misc_feature: HIJSMM301C1K4L.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctgccgttcactttggtccagggaccgaaactaggataatcagacgaactgtgg

SEQ ID NO: 582146 - DNA, 490 bp, Homo sapiens; identical to SEQ ID NO: 534991
  misc_feature: HIJSMM301ATEOI.48.75.G09.1.454.light.4.raw

SEQ ID NO: 582147 - DNA, 441 bp, Homo sapiens; identical to SEQ ID NO: 534971
  misc_feature: HIJSMM301AK0KS.11.3.A03.1.454.light.4.raw

SEQ ID NO: 582148 - DNA, 513 bp, Homo sapiens
  misc_feature: HIJSMM301CEH9S.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggccccaggcagatgatgaatctgtttattattgtgtcctatatatgggtgctggcatttcggtcttcggcggagggaccaagctgaccgtcctac

SEQ ID NO: 582149 - DNA, 447 bp, Homo sapiens; identical to SEQ ID NO: 535020
  misc_feature: HIJSMM301D7MJJ.18.9.A09.1.454.light.4.raw

SEQ ID NO: 582150 - DNA, 447 bp, Homo sapiens; identical to SEQ ID NO: 549542
  misc_feature: HIJSMM301B1PGO.18.9.A09.1.454.light.4.raw

SEQ ID NO: 582151 - DNA, 509 bp, Homo sapiens; identical to SEQ ID NO: 535670
  misc_feature: HIJSMM301AP6LE.47.23.C01.1.454.light.4.raw

SEQ ID NO: 582152 - DNA, 493 bp, Homo sapiens; identical to SEQ ID NO: 537281
  misc_feature: HIJSMM301C6YPN.9.1.A01.1.454.light.4.raw

SEQ ID NO: 582153 - DNA, 485 bp, Homo sapiens; identical to SEQ ID NO: 536040
  misc_feature: HIJSMM301CYHPE.15.1.A01.1.454.light.4.raw

SEQ ID NO: 582154 - DNA, 522 bp, Homo sapiens
  misc_feature: HIJSMM301BY50N.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 582155 - DNA, 503 bp, Homo sapiens; identical to SEQ ID NO: 543109
  misc_feature: HIJSMM301A8T0Z.19.78.H01.1.454.light.4.raw

SEQ ID NO: 582156 - DNA, 502 bp, Homo sapiens; identical to SEQ ID NO: 537363
  misc_feature: HIJSMM301B7WS5.18.23.C01.1.454.light.4.raw

SEQ ID NO: 582157 - DNA, 499 bp, Homo sapiens
  misc_feature: HIJSMM301AHJA9.14.23.C01.1.454.light.4.raw
cgtctagtaccacgaccggtgctcgatttagtacacgtgattagggattgggggaggaactgctcagttaggacccagacggaaccatggaagcccccagcgcagcttctcttcctcctgctactctggctcccagataccactggagaaatagtgatgacgcagtctccagccaccctatctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaaggaccaaggtaggaaatacaaacgaactgtggctacaccatctgtcttc

SEQ ID NO: 582158 - DNA, 495 bp, Homo sapiens
  misc_feature: HIJSMM301AMGJL.52.60.F05.1.454.light.4.raw
cgcagtacgacacgaccggtgctcgatttagtacgtcatcagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaaatcaacagacagcagtggttcttatgtcttcgcaactgggaccaaggtcaccgtcctaggtcagcccaaggccaaccccactgtcact

SEQ ID NO: 582159 - DNA, 483 bp, Homo sapiens
  misc_feature: HIJSMM301C220W.43.44.D11.1.454.light.4.raw
tgtgagtagtcacgaccggtgctcgatttagcgcagtacgaaggggggtcagacccagtcaggacacaacatgcacatgagggtccccgctcagctcctggggctcctgctgctctggctcccaggtgcccaatgtgacatccaggtgacccagtctccttccaccctgtctgcatctgtcggagacagagtcaccatctcttgccgggccagtcaaagttctgtcaggtggttggcctggtatcagcagaagtcagggcaagcccctaggctcctgatgtttaaggcgtctggttcagagagtgaggccccgtccaggttctctgccagtggatctggaacagaactcacactcatcatccgcagcctgcagcctgatgactttgcaacatattactgccaagagtttgatggtcgtttgtggacgttcggccaaggaccagggtagacgtcaaacgaactgtggctgcaccatctgtcttc

SEQ ID NO: 582160 - DNA, 500 bp, Homo sapiens
  misc_feature: HIJSMM301BANX3.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcaccgtacccaaagtaacttttcggccgacgggaaccgaagcgtggagatacaaaacgaactggtcggctgccaccat

SEQ ID NO: 582161 - DNA, 502 bp, Homo sapiens; identical to SEQ ID NO: 539314
  misc_feature: HIJSMM301BUJ7T.21.81.H04.1.454.light.4.raw

SEQ ID NO: 582162 - DNA, 444 bp, Homo sapiens; identical to SEQ ID NO: 535027
  misc_feature: HIJSMM301AKX8E.8.73.G07.1.454.light.4.raw

SEQ ID NO: 582163 - DNA, 447 bp, Homo sapiens; identical to SEQ ID NO: 535020
  misc_feature: HIJSMM301CSG8K.18.9.A09.1.454.light.4.raw

SEQ ID NO: 582164 - DNA, 509 bp, Homo sapiens
  misc_feature: HIJSMM301DROI7.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggagtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaaccccactgtcactatgttcccta

SEQ ID NO: 582165 - DNA, 508 bp, Homo sapiens
  misc_feature: HIJSMM301BJQXR.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaggaccgaacggtaggaagtacaagacgaactagtggcgtgcaccactctgtcttctatcttcccgt

SEQ ID NO: 582166 - DNA, 483 bp, Homo sapiens; identical to SEQ ID NO: 542200
  misc_feature: HIJSMM301BL63A.7.75.G09.1.454.light.4.raw

SEQ ID NO: 582167 - DNA, 494 bp, Homo sapiens; identical to SEQ ID NO: 534994
  misc_feature: HIJSMM301C417I.27.78.H01.1.454.light.4.raw

SEQ ID NO: 582168 - DNA, 509 bp, Homo sapiens; identical to SEQ ID NO: 539359
  misc_feature: HIJSMM301CWDS9.47.85.H08.1.454.light.4.raw

SEQ ID NO: 582169 - DNA, 492 bp, Homo sapiens
  misc_feature: HIJSMM301BZKJ5.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaaggacacgactggagattaaacgaactgtggctgcaccatctgtctt

SEQ ID NO: 582170 - DNA, 479 bp, Homo sapiens; identical to SEQ ID NO: 535118
  misc_feature: HIJSMM301BINQH.13.59.F04.1.454.light.4.raw

SEQ ID NO: 582171 - DNA, 512 bp, Homo sapiens
  misc_feature: HIJSMM301DJG48.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgtcctcctcta

SEQ ID NO: 582172 - DNA, 499 bp, Homo sapiens
  misc_feature: HIJSMM301DDOKV.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagaccgttcggccaagggaccaaggtggaaatcaaacgaactgtggctgcaccta

SEQ ID NO: 582173 - DNA, 509 bp, Homo sapiens
  misc_feature: HIJSMM301EXBEQ.9.52.E08.1.454.light.4.raw
tgatacgtctcacgaccggtgctcgatttagtcgagctctcagagagaaagggggaggaactgctcagttaggacccagagggaaccatggaagccccagcccagcttctcttcctcctgctactctggctcccagaaaacgccggagaaattgtgttggcacagtctccagccaccctgtctatgtctccaggggaaagagccaccctctcctgcagggccagtcagagtgttggtacgtccttactctggtaccaacaaaaacctggccaggctcccaggctcctcatctatgatgcatccaccagggccactggcatccccgccagattcagtggcagtgggtctgggacagacttcactctcaccatcagcagcctggaccctgaagattttgcagtttattactgtcagcagcggaccaattggcccctctccctcactttcggcgggggaccaaggtggagctcaaacgaactgtggctgcaccatctgtcttcatcttcccg

SEQ ID NO: 582174 - DNA, 486 bp, Homo sapiens; identical to SEQ ID NO: 535385
  misc_feature: HIJSMM301DDOVV.19.71.G05.1.454.light.4.raw

SEQ ID NO: 582175 - DNA, 479 bp, Homo sapiens
  misc_feature: HIJSMM301DWR0B.48.29.C07.1.454.light.4.raw
agtatacatacacgaccggtgctcgatttagagtgctacgaagggaaagggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcag

SEQ ID NO: 582176 - DNA, 498 bp, Homo sapiens
  misc_feature: HIJSMM301CYXDY.43.71.G05.1.454.light.4.raw
tgtgagtagtcacgaccggtgctcgatttagtgtcgtcgcaagagagaggggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaaggacacgactggagattaaccgaactgtggctgcaccatctgtcttcta

SEQ ID NO: 582177 - DNA, 496 bp, Homo sapiens; identical to SEQ ID NO: 536248
  misc_feature: HIJSMM301EEE3D.22.27.C05.1.454.light.4.raw

SEQ ID NO: 582178 - DNA, 492 bp, Homo sapiens
  misc_feature: HIJSMM301AZWR5.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctcgtgcacagactctgaggcctcctatgagctgacacagccaccctcggtgtcagtgtccccaggacagacggccaagatcacctgctctggagatgcattgccaaagcaatatgcttattggtaccaacaaaagcctaggccaggcccctgtggtggtgagtatactaaagacagtgagaggccctcagggatccctgagcgattctctggctccagctcagggacaacagtcacgttgaccatcagtggagtccaggcagaggacgaggctgactattattgtcaatcagcagacaacagtaatacttaatctttatgtcttggatctgggaccgagggtcaccgtcctaaggtcagcccaaggccaaccca

SEQ ID NO: 582179 - DNA, 494 bp, Homo sapiens; identical to SEQ ID NO: 571947
  misc_feature: HIJSMM301AS7SI.16.70.G04.1.454.light.4.raw

SEQ ID NO: 582180 - DNA, 492 bp, Homo sapiens
  misc_feature: HIJSMM301BG1UQ.48.53.E09.1.454.light.4.raw
agtatacatacacgaccggtgctcgatttagagagagtgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgccccccg

SEQ ID NO: 582181 - DNA, 496 bp, Homo sapiens
  misc_feature: HIJSMM301DX227.2.35.D02.1.454.light.4.raw
acgctcgacacacgaccggtgctcgatttagcacacgatagttgggtttgggggctttgcctgggctctgctcctcctcagcctcctcactcagggcacaggatcctgggctcagtctgccctgactcagcctcgctcagtgtccgggtctcttggacactcagtcaccatctcctgcgctggagccagcagtgatattggtacttatgactatgtctcctggtaccaacagtacccaggcaaagcccccaaactcctgatttatgatgtctttaaggggccctcaggggtccctgatcgcttctctggctccaagtctggcaacacggcctccctgaccatctctgggctacaggctgaggatgaggctgaatattttgctgctcatatgcaggcagttacgctttgcttttcggcggagggacccagctgaccgtcctaggtcagcccaaggcctgccccctcggtccactctgttcccaccctcctcctgtcg

SEQ ID NO: 582182 - DNA, 503 bp, Homo sapiens
  misc_feature: HIJSMM301B1XUO.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgaagggtggaggatcgaaacgaaacctgtggctgcaccactctgtcttcattccc

SEQ ID NO: 582183 - DNA, 484 bp, Homo sapiens; identical to SEQ ID NO: 535441
  misc_feature: HIJSMM301EQGR7.26.60.F05.1.454.light.4.raw

SEQ ID NO: 582184 - DNA, 487 bp, Homo sapiens
  misc_feature: HIJSMM301D3BUT.46.34.D01.1.454.light.4.raw
actagcagtacacgaccggtgctcgatttagatcgtctgtgttgggtttgggctgatcaggactcctcagttcaccttctcacaatgaggctccctgctcagctcctggggctgctaatgctctgggtcccaggattcagtggggatgttgtgatgactcagtctccactctccctgcccgtcacccttggacagccggcctccatctcctgcaggtctagtcaaagcctcgtatacactgatggaaacacctgcctggattggtatcaccagcggccaggccaatctccaaggcgcctaatttataaggtttctaaccgggactctggggtcccagacagattcagtggcagtgggtcaggcactgagttcacactgaaaatcagcagggtggaggctgaggatgttggaatttattactgcatgcaaggtgcacattggcctccggtcacttttggccaggggaccaagctggagatcaaacgaa

SEQ ID NO: 582185 - DNA, 497 bp, Homo sapiens; identical to SEQ ID NO: 538296
  misc_feature: HIJSMM301ECZLV.18.11.A11.1.454.light.4.raw

SEQ ID NO: 582186 - DNA, 444 bp, Homo sapiens; identical to SEQ ID NO: 534993
  misc_feature: HIJSMM301C8ABM.5.9.A09.1.454.light.4.raw

SEQ ID NO: 582187 - DNA, 497 bp, Homo sapiens; identical to SEQ ID NO: 534982
  misc_feature: HIJSMM301AJVD5.26.80.H03.1.454.light.4.raw

SEQ ID NO: 582188 - DNA, 447 bp, Homo sapiens; identical to SEQ ID NO: 535201
  misc_feature: HIJSMM301A7PGP.18.9.A09.1.454.light.4.raw

SEQ ID NO: 582189 - DNA, 484 bp, Homo sapiens
  misc_feature: HIJSMM301CFY3I.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcacccatctgtt

SEQ ID NO: 582190 - DNA, 490 bp, Homo sapiens; identical to SEQ ID NO: 547085
  misc_feature: HIJSMM301DU0BM.12.51.E07.1.454.light.4.raw

SEQ ID NO: 582191 - DNA, 495 bp, Homo sapiens; identical to SEQ ID NO: 541828
  misc_feature: HIJSMM301BUOW9.19.71.G05.1.454.light.4.raw

SEQ ID NO: 582192 - DNA, 494 bp, Homo sapiens; identical to SEQ ID NO: 544909
  misc_feature: HIJSMM301D5DM1.51.71.G05.1.454.light.4.raw

SEQ ID NO: 582193 - DNA, 509 bp, Homo sapiens; identical to SEQ ID NO: 537131
  misc_feature: HIJSMM301ECX14.17.33.C11.1.454.light.4.raw

SEQ ID NO: 582194 - DNA, 488 bp, Homo sapiens; identical to SEQ ID NO: 567348
  misc_feature: HIJSMM301BV666.14.55.E11.1.454.light.4.raw

SEQ ID NO: 582195 - DNA, 489 bp, Homo sapiens
  misc_feature: HIJSMM301AKPPS.48.78.H01.1.454.light.4.raw
agtatacatacacgaccggtgctcgatttagtgtgagtagtttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcg

SEQ ID NO: 582196 - DNA, 499 bp, Homo sapiens
  misc_feature: HIJSMM301EBGXC.52.78.H01.1.454.light.4.raw
cgcagtacgacacgaccggtgctcgatttagtgtgagtagtttgggtttgggggtggggtccaggaggcagaactctgggtgtctcaccatggcctggatccctctacttctccccctcctcactctctgcacaggctctggggcctcctatgaactggcacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctggtcact

SEQ ID NO: 582197 - DNA, 501 bp, Homo sapiens; identical to SEQ ID NO: 548094
  misc_feature: HIJSMM301C3QE8.41.45.E01.1.454.light.4.raw

SEQ ID NO: 582198 - DNA, 490 bp, Homo sapiens
  misc_feature: HIJSMM301C10R0.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgtcgtcacggaccgacggtcggagtgtcagacgaacgtagtggcgtgcaccactctcg

SEQ ID NO: 582199 - DNA, 504 bp, Homo sapiens
  misc_feature: HIJSMM301EQ2YE.5.68.G02.1.454.light.4.raw
  modified_base (219)..(219): a, c, t, g, unknown or other
  modified_base (491)..(491): a, c, t, g, unknown or other
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttanaagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcgagggaccaggctgaccgtcctgggtcagcccaaggctgccccctcggtcactctgttcccnccctcctccgtgt

SEQ ID NO: 582200 - DNA, 492 bp, Homo sapiens; identical to SEQ ID NO: 535864
  misc_feature: HIJSMM301CCBX1.3.71.G05.1.454.light.4.raw

SEQ ID NO: 582201 - DNA, 517 bp, Homo sapiens
  misc_feature: HIJSMM301C5G0X.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagcctccctagagcctggagtattttgtagttttattactgtcagcagtatagcagctggcctcccacctttcggcgggacgggaccgaaggtggaggactaccaacgtaactgtggctgcaccatctgtcttctatccttccccg

SEQ ID NO: 582202 - DNA, 505 bp, Homo sapiens
  misc_feature: HIJSMM301CQGQV.48.79.H02.1.454.light.4.raw
agtatacatacacgaccggtgctcgatttagtgtcacacgaagggaaagggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggtggaaatcaaacgaactgtggctgcacca

SEQ ID NO: 582203 - DNA, 504 bp, Homo sapiens; identical to SEQ ID NO: 555616
  misc_feature: HIJSMM301C5W11.5.86.H09.1.454.light.4.raw

SEQ ID NO: 582204 - DNA, 486 bp, Homo sapiens; identical to SEQ ID NO: 535290
  misc_feature: HIJSMM301EX4KD.3.12.B01.1.454.light.4.raw

SEQ ID NO: 582205 - DNA, 494 bp, Homo sapiens; identical to SEQ ID NO: 534992
  misc_feature: HIJSMM301A2ID6.9.1.A01.1.454.light.4.raw

SEQ ID NO: 582206 - DNA, 510 bp, Homo sapiens; identical to SEQ ID NO: 549444
  misc_feature: HIJSMM301ADCKT.4.57.F02.1.454.light.4.raw

SEQ ID NO: 582207 - DNA, 497 bp, Homo sapiens
  misc_feature: HIJSMM301CKQBZ.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacttcggccaagggaccaaaggtggacctcaaacgaactgtggctgcaccat

SEQ ID NO: 582208 - DNA, 512 bp, Homo sapiens
  misc_feature: HIJSMM301EJFPK.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctcgggtcgttcggaccgaagggaccgaaggtgggaaatacgaaacgaactagtggctgccacatctgtcttcatcttccccg

SEQ ID NO: 582209 - DNA, 518 bp, Homo sapiens; identical to SEQ ID NO: 539372
  misc_feature: HIJSMM301BK4EW.7.86.H09.1.454.light.4.raw

SEQ ID NO: 582210 - DNA, 497 bp, Homo sapiens; identical to SEQ ID NO: 536376
  misc_feature: HIJSMM301BSSEL.22.9.A09.1.454.light.4.raw

SEQ ID NO: 582211 - DNA, 496 bp, Homo sapiens
  misc_feature: HIJSMM301EI2HE.43.72.G06.1.454.light.4.raw
tgtgagtagtcacgaccggtgctcgatttagctacgactgcaagggaaaggggctgggcctcaggaagcagcatcggaggtgcctcagccatggcatggatccctctcttcctcggcgtccttgcttactgcacaggatccgtggccgcctatgagttgactcagccaccctcagtgtccgtgtccccaggacagacagccagcatcacctgctctggagataaattgggggataaatatgcctcctggtatcagcagaagccaggcgagtcccctgtgttggtcatctatcaagatgacaaacggccctcagggatccctgagcgattctctggctccaactctgggaacacagccactctgaccatcagcgggacccaggctatggatgaggctgacttttactgtcaggcgtgggacaccaacactgtggttttcggcggagggaccaaggctgaccgtcctaggtcagcccaaggctgccccctcggtccta

SEQ ID NO: 582212 - DNA, 490 bp, Homo sapiens; identical to SEQ ID NO: 535234
  misc_feature: HIJSMM301CV6W3.17.21.B10.1.454.light.4.raw

SEQ ID NO: 582213 - DNA, 496 bp, Homo sapiens; identical to SEQ ID NO: 535109
  misc_feature: HIJSMM301AY9TC.16.78.H01.1.454.light.4.raw

SEQ ID NO: 582214 - DNA, 507 bp, Homo sapiens; identical to SEQ ID NO: 542621
  misc_feature: HIJSMM301EM00X.4.10.A10.1.454.light.4.raw

SEQ ID NO: 582215 - DNA, 504 bp, Homo sapiens; identical to SEQ ID NO: 536385
  misc_feature: HIJSMM301EY75F.27.78.H01.1.454.light.4.raw

SEQ ID NO: 582216 - DNA, 493 bp, Homo sapiens
  misc_feature: HIJSMM301D7GLL.21.27.C05.1.454.light.4.raw
tcgtcgctcgcacgaccggtgctcgatttagacgcgatcgaagggtttggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttattctgccagcaatataattactggcctgcgtcgacgttcggccacgggaccaaggtggaaatcaaacgaactgtggctgcaccatctgtctt

SEQ ID NO: 582217 - DNA, 479 bp, Homo sapiens; identical to SEQ ID NO: 535118
  misc_feature: HIJSMM301BRVBY.13.59.F04.1.454.light.4.raw

SEQ ID NO: 582218 - DNA, 503 bp, Homo sapiens
  misc_feature: HIJSMM301C09IP.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaaatgggaccaaggtcaccgtcctaggtcagcccaaggccaacccactgtcta

SEQ ID NO: 582219 - DNA, 513 bp, Homo sapiens
  misc_feature: HIJSMM301CJU62.48.53.E09.1.454.light.4.raw
agtatacatacacgaccggtgctcgatttagagagagtgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccaccct

SEQ ID NO: 582220 - DNA, 513 bp, Homo sapiens
  misc_feature: HIJSMM301A8Y3W.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactacttttatgttcgggactgggaccaaggtcaccgtcctaggtcagcccaaggccaaccccactgtcactcttcg

SEQ ID NO: 582221 - DNA, 494 bp, Homo sapiens; identical to SEQ ID NO: 534992
  misc_feature: HIJSMM301CB4M6.9.1.A01.1.454.light.4.raw

SEQ ID NO: 582222 - DNA, 487 bp, Homo sapiens
  misc_feature: HIJSMM301AT2HM.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtggctgcaccatctgtta

SEQ ID NO: 582223 - DNA, 494 bp, Homo sapiens
  misc_feature: HIJSMM301BTY59.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtatttggcggtgggaccaagctgaccgtcctaggtcagcccaagg

SEQ ID NO: 582224 - DNA, 445 bp, Homo sapiens; identical to SEQ ID NO: 537719
  misc_feature: HIJSMM301B906S.47.85.H08.1.454.light.4.raw

SEQ ID NO: 582225 - DNA, 519 bp, Homo sapiens
  misc_feature: HIJSMM301BM9Y6.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgcct

SEQ ID NO: 582226 - DNA, 479 bp, Homo sapiens
  misc_feature: HIJSMM301BQRDB.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctgttccccgcctcctcgagtagtaca

SEQ ID NO: 582227 - DNA, 473 bp, Homo sapiens
  misc_feature: HIJSMM301CTSLV.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactggggtcccatcaaggttcagcggcagtggatctgcaacagacttcaatctcaccatcagcagcctgcagcctgaagattttgcaatttattactgtctgcaggattacacataccctcgaaccgttcggccaagggaccaacggtggaaattcaaacgaactgt

SEQ ID NO: 582228 - DNA, 481 bp, Homo sapiens
  misc_feature: HIJSMM301C7E7E.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggcctaggggaccaggctggagatcagacgaa

SEQ ID NO: 582229 - DNA, 471 bp, Homo sapiens
  misc_feature: HIJSMM301BB3I3.49.75.G09.1.454.light.4.raw
agtcgagagacacgaccggtgctcgatttagtatagacatcaggggcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagtattttactttcaccatcagcaggctgcagcctgaagatattgcaacatattactgtcaacagtatgatagtctcccgctcactttcggcgggggaccgaaggtggaggatccagcgaactgtggctgca

SEQ ID NO: 582230 - DNA, 503 bp, Homo sapiens; identical to SEQ ID NO: 536834
  misc_feature: HIJSMM301AR1CP.2.35.D02.1.454.light.4.raw

SEQ ID NO: 582231 - DNA, 500 bp, Homo sapiens; identical to SEQ ID NO: 545106
  misc_feature: HIJSMM301EYS4G.17.27.C05.1.454.light.4.raw

SEQ ID NO: 582232 - DNA, 482 bp, Homo sapiens
  misc_feature: HIJSMM301AQHOI.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccatgaccattactggactccaggctgacgacgaagctgattattactgctcagcatgggacaccggcctcagtgcgtgggttttcggtcggagggaccgaagctgaccgtcctaggtcacg

SEQ ID NO: 582233 - DNA, 492 bp, Homo sapiens; identical to SEQ ID NO: 540272
  misc_feature: HIJSMM301BV45R.41.23.C01.1.454.light.4.raw

SEQ ID NO: 582234 - DNA, 503 bp, Homo sapiens; identical to SEQ ID NO: 551625
  misc_feature: HIJSMM301DJLCZ.10.71.G05.1.454.light.4.raw

SEQ ID NO: 582235 - DNA, 486 bp, Homo sapiens; identical to SEQ ID NO: 535043
  misc_feature: HIJSMM301BG21J.46.35.D02.1.454.light.4.raw

SEQ ID NO: 582236 - DNA, 513 bp, Homo sapiens
  misc_feature: HIJSMM301CSKWL.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacggaggctgattactactgctgctcatatgcgaggtcgtatctcttatgtcttcggaactgggaccaaggtccaccgtccgtaggtcacgcccgaacggacccaaccccactcgtcactctcgttccccacccctcctccacgagacgta

SEQ ID NO: 582237 - DNA, 470 bp, Homo sapiens
  misc_feature: HIJSMM301BWNT5.16.4.A04.1.454.light.4.raw
tgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgcaacctattattgccaacagtataatagttatccgtgacgttcggccaaggaccgacggtggacgatcaaacgaactagtggc

SEQ ID NO: 582238 - DNA, 495 bp, Homo sapiens; identical to SEQ ID NO: 549993
  misc_feature: HIJSMM301DC6YH.13.6.A06.1.454.light.4.raw

SEQ ID NO: 582239 - DNA, 457 bp, Homo sapiens; identical to SEQ ID NO: 546935
  misc_feature: HIJSMM301E1NMY.53.83.H06.1.454.light.4.raw

SEQ ID NO: 582240 - DNA, 441 bp, Homo sapiens; identical to SEQ ID NO: 550529
  misc_feature: HIJSMM301EKV1X.41.9.A09.1.454.light.4.raw

SEQ ID NO: 582241 - DNA, 490 bp, Homo sapiens; identical to SEQ ID NO: 541567
  misc_feature: HIJSMM301AWOLX.22.65.F10.1.454.light.4.raw

SEQ ID NO: 582242 - DNA, 484 bp, Homo sapiens
  misc_feature: HIJSMM301BCDE7.49.27.C05.1.454.light.4.raw
agtcgagagacacgaccggtgctcgatttagacgcgatcgaagggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagacgtgaagatgtggcagtgtattactgtcagcaatatcacactgctccgctcactttcggcggagggaccagggtggagatcaaacgaa

SEQ ID NO: 582243 - DNA, 493 bp, Homo sapiens
  misc_feature: HIJSMM301APD9Z.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggtccaggggaccgaaactaggatatcagacgaactgtggctgca

SEQ ID NO: 582244 - DNA, 500 bp, Homo sapiens
  misc_feature: HIJSMM301DERG9.22.15.B04.1.454.light.4.raw
  modified_base (452)..(452): a, c, t, g, unknown or other
acatacgcgtcacgaccggtgctcgatttagacagtatatatccgcgggggctggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctcctgaccgtctctgggctccaggctgaggatgaggctgattatactgcagctcatatggaggcagcgacaatttggtgttcggnggagggaccaagctgaccgtcctaggtcagcccaaggctcgccccctc

SEQ ID NO: 582245 - DNA, 502 bp, Homo sapiens; identical to SEQ ID NO: 553118
  misc_feature: HIJSMM301C5N2M.10.9.A09.1.454.light.4.raw

SEQ ID NO: 582246 - DNA, 492 bp, Homo sapiens
  misc_feature: HIJSMM301DSC10.3.33.C11.1.454.light.4.raw
agacgcactccacgaccggtgctcgatttagagtgagctcgttgggtttggggggggtctcaggaggcagcgctctcaggacgtcaccagcatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcg

SEQ ID NO: 582247 - DNA, 479 bp, Homo sapiens
  misc_feature: HIJSMM301AQJBZ.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccactcattttcggcggagggaccaaggtgcagatcaaacgaactgtgg

SEQ ID NO: 582248 - DNA, 500 bp, Homo sapiens; identical to SEQ ID NO: 572186
  misc_feature: HIJSMM301D9X2D.5.86.H09.1.454.light.4.raw

SEQ ID NO: 582249 - DNA, 519 bp, Homo sapiens
  misc_feature: HIJSMM301CLUI6.52.57.F02.1.454.light.4.raw
cgcagtacgacacgaccggtgctcgatttagctcgatatagttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgaccttggtgcttatgactttgtctcctggtaccaacaccaccctggcaaagcccccaaactcatcatttttgaggtcactaagcggccctcaggggtccctgatcgcttctctggctcgaagtctggcaacacggcctcctgaccgtctctgggctccaggctgaggatgaggctgattactactgcacctcatatgcaggcgacaacaatttggggttttcggcggagggaccaaggtgaccgtcctacgtcagcccaaggctgccccctcggtcactctgtttcccg

SEQ ID NO: 582250 - DNA, 477 bp, Homo sapiens; identical to SEQ ID NO: 535506
  misc_feature: HIJSMM301EK1DL.7.67.G01.1.454.light.4.raw

SEQ ID NO: 582251 - DNA, 485 bp, Homo sapiens; identical to SEQ ID NO: 536040
  misc_feature: HIJSMM301AQ48H.15.1.A01.1.454.light.4.raw

SEQ ID NO: 582252 - DNA, 503 bp, Homo sapiens; identical to SEQ ID NO: 551625
  misc_feature: HIJSMM301AQW9N.10.71.G05.1.454.light.4.raw

SEQ ID NO: 582253 - DNA, 487 bp, Homo sapiens; identical to SEQ ID NO: 540557
  misc_feature: HIJSMM301AVI7X.41.44.D11.1.454.light.4.raw

SEQ ID NO: 582254 - DNA, 487 bp, Homo sapiens
  misc_feature: HIJSMM301CLCLR.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccctacaatttcggtcaggggaccaagttgaacatcaatcgaactgtggctgcacc

SEQ ID NO: 582255 - DNA, 485 bp, Homo sapiens
  misc_feature: HIJSMM301C3S3C.4.71.G05.1.454.light.4.raw
agcactgtagcacgaccggtgctcgatttagtgtcgtcgcaagagagagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccgccatcagctgcaagtccagccagagtgttttattcagctccaacaataagaactacttagcttggtaccagcagaaaccaggacagcctcctaacctgctcatttactgggcatctacccgggaatccggggtccctgaccgattcagtggcagcgggtctgggacagatttcactctcaccatcaacagcctgcaggctgaagatgtggcagtttattactgtcagcagtattatataactcccttcactttcggcggagggaccaaggtggagatcaaacgaa

SEQ ID NO: 582256 - DNA, 499 bp, Homo sapiens; identical to SEQ ID NO: 551727
  misc_feature: HIJSMM301BDMJJ.12.37.D04.1.454.light.4.raw

SEQ ID NO: 582257 - DNA, 494 bp, Homo sapiens; identical to SEQ ID NO: 534994
  misc_feature: HIJSMM301AK9D2.27.78.H01.1.454.light.4.raw

SEQ ID NO: 582258 - DNA, 454 bp, Homo sapiens
  misc_feature: HIJSMM301EJTFI.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccaccgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttcactggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 582259 - DNA, 497 bp, Homo sapiens; identical to SEQ ID NO: 535286
  misc_feature: HIJSMM301BV8JA.18.59.F04.1.454.light.4.raw

SEQ ID NO: 582260 - DNA, 489 bp, Homo sapiens; identical to SEQ ID NO: 541933
  misc_feature: HIJSMM301DIP9D.13.46.E02.1.454.light.4.raw

SEQ ID NO: 582261 - DNA, 497 bp, Homo sapiens
  misc_feature: HIJSMM301EFLH1.15.25.C03.1.454.light.4.raw
tctacgtagccacgaccggtgctcgatttagtagtgtagatttgggtttgggggatcaggactcctcatttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaacccgatcaccttcggccgagggacacgcctggagattaaacgaactgtggctgcaccat

SEQ ID NO: 582262 - DNA, 488 bp, Homo sapiens; identical to SEQ ID NO: 539884
  misc_feature: HIJSMM301A51G0.7.85.H08.1.454.light.4.raw

SEQ ID NO: 582263 - DNA, 465 bp, Homo sapiens
  misc_feature: HIJSMM301ECQI1.49.75.G09.1.454.light.4.raw
agtcgagagacacgaccggtgctcgatttagtatagacatcaggggcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggatctgggacagattttactttcaccaatcagcagcctgcagcctgaagatattgcaacatattaactgtcaacagtatgataatctcccactcactttcgcggagggaccaaggtggagatcaaacgaactgtgg

SEQ ID NO: 582264 - DNA, 476 bp, Homo sapiens
  misc_feature: HIJSMM301BQNAB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctacgttttggcggggggaccgaaggtggacatcaaacgaact

SEQ ID NO: 582265 - DNA, 486 bp, Homo sapiens; identical to SEQ ID NO: 537127
  misc_feature: HIJSMM301CRFUJ.3.77.G11.1.454.light.4.raw

SEQ ID NO: 582266 - DNA, 504 bp, Homo sapiens
  misc_feature: HIJSMM301BMSIY.41.21.B10.1.454.light.4.raw
tctatactatcacgaccggtgctcgatttagtgtcgtcgcaagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatatcgcaacttattactgtcaacaatataacacttaattcaggggcattcggccaagggaccaaggtggaaattaaacgaactgtggctgcaccatctgtcttcatcttcccgccta

SEQ ID NO: 582267 - DNA, 492 bp, Homo sapiens; identical to SEQ ID NO: 559560
  misc_feature: HIJSMM301A9449.16.53.E09.1.454.light.4.raw

SEQ ID NO: 582268 - DNA, 511 bp, Homo sapiens
  misc_feature: HIJSMM301DM3GJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaacgggaccgaaggtaggaaagtcaaaacgaactagtggcgtgcaccatctgtcttctatcttccccg

SEQ ID NO: 582269 - DNA, 489 bp, Homo sapiens
  misc_feature: HIJSMM301EFP8O.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtcacgtcccaagtaacttttggccgagggaccaagctggagatacaaacgaactgtggctgcaccat

SEQ ID NO: 582270 - DNA, 496 bp, Homo sapiens; identical to SEQ ID NO: 535109
  misc_feature: HIJSMM301CR6CD.16.78.H01.1.454.light.4.raw

SEQ ID NO: 582271 - DNA, 519 bp, Homo sapiens
  misc_feature: HIJSMM301CU2OH.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctcacgtcg

SEQ ID NO: 582272 - DNA, 508 bp, Homo sapiens
  misc_feature: HIJSMM301B433C.51.87.H10.1.454.light.4.raw
cgatcgtatacacgaccggtgctcgatttagcagtactgcgttgggtttgggggatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatcaaacgaactgtggctgcaccatctgtcttcat

SEQ ID NO: 582273 - DNA, 492 bp, Homo sapiens; identical to SEQ ID NO: 547805
  misc_feature: HIJSMM301BOL6P.48.38.D05.1.454.light.4.raw

SEQ ID NO: 582274 - DNA, 513 bp, Homo sapiens; identical to SEQ ID NO: 547639
  misc_feature: HIJSMM301EK6Z9.43.59.F04.1.454.light.4.raw

SEQ ID NO: 582275 - DNA, 503 bp, Homo sapiens
  misc_feature: HIJSMM301DXXYU.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcaacccaaataaagcccccaaactcatcatttatgatgccactaagcggccctcaggggtttctaatcgcttctctggctccaagtctggcaacacggcctcctgacatctctgggctccaggctgaggacgaggctgattactactgctgctcatatgcaggtcgtatctcttatgtcttcggaactgggaccaaggtcaccgtctaggtcagcccaaggcccaacccactgtca

SEQ ID NO: 582276 - DNA, 498 bp, Homo sapiens
  misc_feature: HIJSMM301EFC08.51.29.C07.1.454.light.4.raw
cgatcgtatacacgaccggtgctcgatttagagtgctacgaagggaaaggggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaagtgaaaggaaactgtggctgcaccatctgtctt

SEQ ID NO: 582277 - DNA, 505 bp, Homo sapiens; identical to SEQ ID NO: 541350
  misc_feature: HIJSMM301DXYPK.2.71.G05.1.454.light.4.raw

SEQ ID NO: 582278 - DNA, 482 bp, Homo sapiens
  misc_feature: HIJSMM301EI36J.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcgggcggagggaccaggctgaccgtctaggtcagcccaaggctcgccccccg

SEQ ID NO: 582279 - DNA, 498 bp, Homo sapiens; identical to SEQ ID NO: 553891
  misc_feature: HIJSMM301D7TSW.3.33.C11.1.454.light.4.raw

SEQ ID NO: 582280 - DNA, 492 bp, Homo sapiens; identical to SEQ ID NO: 537395
  misc_feature: HIJSMM301EIUGD.16.73.G07.1.454.light.4.raw

SEQ ID NO: 582281 - DNA, 485 bp, Homo sapiens
  misc_feature: HIJSMM301COQDQ.40.83.H06.1.454.light.4.raw
tctagcgactcacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcgggcggagggaccaaactgtccgtcctaggtcacg

SEQ ID NO: 582282 - DNA, 499 bp, Homo sapiens
  misc_feature: HIJSMM301DPD9Y.13.11.A11.1.454.light.4.raw
tcacgtactacacgaccggtgctcgatttagctacgactgcagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctagtggatgaggctgactattactgtcaggcgtgggacagcagcactgcccgctacgtacgtcgttaccgaaacgtcggaaccgtacgtacgtaccgtacctaacgtacgacgaacccccg

SEQ ID NO: 582283 - DNA, 519 bp, Homo sapiens
  misc_feature: HIJSMM301ESM49.48.29.C07.1.454.light.4.raw
agtatacatacacgaccggtgctcgatttagagtgctacgaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccgccct

SEQ ID NO: 582284 - DNA, 501 bp, Homo sapiens
  misc_feature: HIJSMM301CX1TB.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcgagggaccaagctgaccgtcctgggtcagcccaaggctgccccctggtca

SEQ ID NO: 582285 - DNA, 484 bp, Homo sapiens; identical to SEQ ID NO: 537399
  misc_feature: HIJSMM301AVXAT.7.75.G09.1.454.light.4.raw

SEQ ID NO: 582286 - DNA, 520 bp, Homo sapiens; identical to SEQ ID NO: 539176
  misc_feature: HIJSMM301D5UIC.27.23.C01.1.454.light.4.raw

SEQ ID NO: 582287 - DNA, 499 bp, Homo sapiens
  misc_feature: HIJSMM301DZ1HG.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactccgggacagcagtgctgaccaggtggtattcggcggagggacccacctgaccgtcttaggtcagcccaaggctgccccctcggtc

SEQ ID NO: 582288 - DNA, 519 bp, Homo sapiens
  misc_feature: HIJSMM301ELXDS.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggaccccagaccctggagcctcagttggaagcagccgatccagcctgcggagcctgtgggcaggtcagcccaaggccaaccccactgtcactctcg

SEQ ID NO: 582289 - DNA, 505 bp, Homo sapiens
  misc_feature: HIJSMM301ET85J.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaaccccactgtcactctgttcccaccct

SEQ ID NO: 582290 - DNA, 489 bp, Homo sapiens; identical to SEQ ID NO: 535139
  misc_feature: HIJSMM301BC5BV.14.55.E11.1.454.light.4.raw

SEQ ID NO: 582291 - DNA, 487 bp, Homo sapiens
  misc_feature: HIJSMM301CT2OK.52.53.E09.1.454.light.4.raw
cgcagtacgacacgaccggtgctcgatttagagagagtgtgttgggtttgggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagcctccagtctgaggacgagggtgactattactgtcagacgtgggacactggcagtttgggtgttcggcggagggaccaaggttgaccgtcctaggtcagcccaaggctccg

SEQ ID NO: 582292 - DNA, 520 bp, Homo sapiens
  misc_feature: HIJSMM301EBVC8.53.65.F10.1.454.light.4.raw
cgcgtatacacacgaccggtgctcgatttagctacgctctaaggggctgggcctaaggaagcagcactggtggtgcctcagccatggcctggaccgttctcctcctcggcctcctctctcactgcacagactctgtgacctcctatgtgctgactcagccaacctcggtgtcagtggccccaggacagacggccagcattacctgtgggggaaaccacattggagctaaaaatgtgcactggtaccagcagaagccaggccaggcccctgtgctggtcgtctataatggaagcggccggccctcatggatccctgggcgattctctggctccaagtctgggaacacgaccaccctaaccatcagcagggtcgaagccggggatgaggccgactattactgtcaggtgtgggataatagtaatggtggggaattgggtgttcggcggagggaccaagctgaccgtcctaggtcagcccaaggctgccccctcggtcactctgttcccgccctcctctcgta

SEQ ID NO: 582293 - DNA, 506 bp, Homo sapiens
  misc_feature: HIJSMM301CFZQW.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccgaaggtggagatcaaacgaactgtggctgcacatctgtt

SEQ ID NO: 582294 - DNA, 496 bp, Homo sapiens; identical to SEQ ID NO: 535109
  misc_feature: HIJSMM301CEB9V.16.78.H01.1.454.light.4.raw

SEQ ID NO: 582295 - DNA, 486 bp, Homo sapiens; identical to SEQ ID NO: 535043
  misc_feature: HIJSMM301AKDEL.46.35.D02.1.454.light.4.raw

SEQ ID NO: 582296 - DNA, 476 bp, Homo sapiens
  misc_feature: HIJSMM301EF9QJ.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtacaaaagtataacagtgcccccttcacccttcggccaagggacacgactggagattagaacg

SEQ ID NO: 582297 - DNA, 490 bp, Homo sapiens; identical to SEQ ID NO: 546232
  misc_feature: HIJSMM301AFRFA.51.28.C06.1.454.light.4.raw

SEQ ID NO: 582298 - DNA, 490 bp, Homo sapiens; identical to SEQ ID NO: 547085
  misc_feature: HIJSMM301DDKVN.12.51.E07.1.454.light.4.raw

SEQ ID NO: 582299 - DNA, 516 bp, Homo sapiens; identical to SEQ ID NO: 552129
  misc_feature: HIJSMM301BFRBF.27.23.C01.1.454.light.4.raw

SEQ ID NO: 582300 - DNA, 486 bp, Homo sapiens; identical to SEQ ID NO: 535043
  misc_feature: HIJSMM301BKDOW.46.35.D02.1.454.light.4.raw

SEQ ID NO: 582301 - DNA, 510 bp, Homo sapiens; identical to SEQ ID NO: 553863
  misc_feature: HIJSMM301AYR9Y.16.46.E02.1.454.light.4.raw

SEQ ID NO: 582302 - DNA, 475 bp, Homo sapiens; identical to SEQ ID NO: 551151
  misc_feature: HIJSMM301EVCYB.13.76.G10.1.454.light.4.raw

SEQ ID NO: 582303 - DNA, 486 bp, Homo sapiens; identical to SEQ ID NO: 548935
  misc_feature: HIJSMM301C888I.47.38.D05.1.454.light.4.raw

SEQ ID NO: 582304 - DNA, 493 bp, Homo sapiens; identical to SEQ ID NO: 537239
  misc_feature: HIJSMM301AY8WF.49.66.F11.1.454.light.4.raw

SEQ ID NO: 582305 - DNA, 502 bp, Homo sapiens
  misc_feature: HIJSMM301B3Q52.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagtattttgctagtttattactgtcagcagtataatgtacttgggttttattctactttccggtcccgtcgggaccaaagtggtatttcagacgaactgtggctgcaccatctgtcttcta

SEQ ID NO: 582306 - DNA, 481 bp, Homo sapiens
  misc_feature: HIJSMM301AOH3W.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggcaaactgaccgtcctaggtcagcccaaggctgccccc

SEQ ID NO: 582307 - DNA, 494 bp, Homo sapiens
  misc_feature: HIJSMM301DACB1.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtccacgggaccgacggtcggagtgtctaagcgaactgtggcgtgcgaccactcttcg

SEQ ID NO: 582308 - DNA, 444 bp, Homo sapiens; identical to SEQ ID NO: 535856
  misc_feature: HIJSMM301EOFZL.9.9.A09.1.454.light.4.raw

SEQ ID NO: 582309 - DNA, 502 bp, Homo sapiens; identical to SEQ ID NO: 541501
  misc_feature: HIJSMM301A8GBD.17.27.C05.1.454.light.4.raw

SEQ ID NO: 582310 - DNA, 482 bp, Homo sapiens; identical to SEQ ID NO: 537007
  misc_feature: HIJSMM301AH0M4.41.34.D01.1.454.light.4.raw

SEQ ID NO: 582311 - DNA, 500 bp, Homo sapiens
  misc_feature: HIJSMM301DC10N.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctggtcactcc

SEQ ID NO: 582312 - DNA, 467 bp, Homo sapiens
  misc_feature: HIJSMM301D0Z9B.52.19.B08.1.454.light.4.raw
cgcagtacgacacgaccggtgctcgatttagtgagtcagtaagggggcaggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcggggggaccgaaggtggagatcaagcgaa

SEQ ID NO: 582313 - DNA, 506 bp, Homo sapiens
  misc_feature: HIJSMM301C92WC.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacctttcggccctgggaccaaagtggatatcaaacgaaactgtggctgcaccatctgtt

SEQ ID NO: 582314 - DNA, 503 bp, Homo sapiens
  misc_feature: HIJSMM301BVL9W.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtnttcggcggagggaccaaactgaccgtcctaaggtcagcccaa

SEQ ID NO: 582315 - DNA, 542 bp, Homo sapiens
  misc_feature: HIJSMM301AF8K7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccaacgggaccgaacggtaggaaggtacgaaaccgaaacgtagtggcgtgcgaccactctcgttcttcctactcttccccgtcccgtacctcttacgtacg

SEQ ID NO: 582316 - DNA, 494 bp, Homo sapiens; identical to SEQ ID NO: 535478
  misc_feature: HIJSMM301ASXHG.10.79.H02.1.454.light.4.raw

SEQ ID NO: 582317 - DNA, 484 bp, Homo sapiens; identical to SEQ ID NO: 536162
  misc_feature: HIJSMM301AWAWY.13.59.F04.1.454.light.4.raw

SEQ ID NO: 582318 - DNA, 504 bp, Homo sapiens
  misc_feature: HIJSMM301CKNUX.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtca

SEQ ID NO: 582319 - DNA, 501 bp, Homo sapiens
  misc_feature: HIJSMM301B53QM.43.69.G03.1.454.light.4.raw
tgtgagtagtcacgaccggtgctcgatttagtcgctgcgtaaaggagaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttagtcggtgttcggcgggggacgaagctgaccgtcctaggtcagccaaggctcgccccctcggtcactccg

SEQ ID NO: 582320 - DNA, 478 bp, Homo sapiens; identical to SEQ ID NO: 575465
  misc_feature: HIJSMM301DOMM8.21.25.C03.1.454.light.4.raw

SEQ ID NO: 582321 - DNA, 503 bp, Homo sapiens
  misc_feature: HIJSMM301BEVK9.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaaacatgggatgacaatctgagcggttgggtgttcggcggagggaccaaactgaccgtcctaggtcagcccaa

SEQ ID NO: 582322 - DNA, 375 bp, Homo sapiens; identical to SEQ ID NO: 537938
  misc_feature: HIJSMM301BMDM8.9.11.A11.1.454.light.4.raw

SEQ ID NO: 582323 - DNA, 485 bp, Homo sapiens
  misc_feature: HIJSMM301BOY8X.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggtcaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttggcggagggaccaaggtggagatcaaacgaactgtggctgcaccat

SEQ ID NO: 582324 - DNA, 485 bp, Homo sapiens
  misc_feature: HIJSMM301DH76N.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtaccctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattacttgcatgcaagctctacaagtcccgctcactttcggcggagggaccaaggtgagatcaaacgaa

SEQ ID NO: 582325 - DNA, 522 bp, Homo sapiens
  misc_feature: HIJSMM301B71O7.27.23.C01.1.454.light.4.raw
  modified_base (519)..(519): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttctatatacaaccagtgacacttgggtgttcggtcggagggaccaggctgaccgtcctaggtcagcccaaggctgccccctcggtcactctgttcccncct

SEQ ID NO: 582326 - DNA, 482 bp, Homo sapiens
  misc_feature: HIJSMM301COEU3.49.83.H06.1.454.light.4.raw
agtcgagagacacgaccggtgctcgatttagatcacgtgcgtcgcggggcaggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccatcaacagcctgcagcctgatgattttgcaacttattactgccaacactataatcattattctccggccacttcgtccctggccagactagatatcggacgaactgttgctgcacca

SEQ ID NO: 582327 - DNA, 517 bp, Homo sapiens
  misc_feature: HIJSMM301CL5W1.48.37.D04.1.454.light.4.raw
  modified_base (512)..(512): a, c, t, g, unknown or other
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttccgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtccactctcgttcccnccctt

SEQ ID NO: 582328 - DNA, 494 bp, Homo sapiens; identical to SEQ ID NO: 534994
  misc_feature: HIJSMM301CEKKG.27.78.H01.1.454.light.4.raw

SEQ ID NO: 582329 - DNA, 498 bp, Homo sapiens
  misc_feature: HIJSMM301D4UVL.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgccccc

SEQ ID NO: 582330 - DNA, 516 bp, Homo sapiens; identical to SEQ ID NO: 545729
  misc_feature: HIJSMM301D0XN8.9.20.B09.1.454.light.4.raw

SEQ ID NO: 582331 - DNA, 473 bp, Homo sapiens
  misc_feature: HIJSMM301EANR4.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggacagatttcactctcaccatcaacagtctgcaacctgaagattttgcaacttactactgtacaacagagtttcactacccctctcactttcggcgggggaccgaaggtggagatcaaacgaa

SEQ ID NO: 582332 - DNA, 480 bp, Homo sapiens
  misc_feature: HIJSMM301A6ZMD.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccgaaagtggatgtcaaccgaacctagtggctgcaccta

SEQ ID NO: 582333 - DNA, 518 bp, Homo sapiens; identical to SEQ ID NO: 554773
  misc_feature: HIJSMM301A1E6L.47.53.E09.1.454.light.4.raw

SEQ ID NO: 582334 - DNA, 518 bp, Homo sapiens
  misc_feature: HIJSMM301CKK3R.51.27.C05.1.454.light.4.raw
cgatcgtatacacgaccggtgctcgatttagacgcgatcgaagggtttgggggggtcgtcaggaggcagcgctctcgggacgtctccaccatggcctgggctctgctattcctcaccctcctcactcagggcacagggtccgtgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtcactctgttccccg

SEQ ID NO: 582335 - DNA, 496 bp, Homo sapiens; identical to SEQ ID NO: 537925
  misc_feature: HIJSMM301A4N8P.22.14.B03.1.454.light.4.raw

SEQ ID NO: 582336 - DNA, 485 bp, Homo sapiens
  misc_feature: HIJSMM301B9YWB.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttgtggacgttcggccaagggaccaaggtggatatcagacgaa

SEQ ID NO: 582337 - DNA, 490 bp, Homo sapiens; identical to SEQ ID NO: 539196
  misc_feature: HIJSMM301EK2N1.22.65.F10.1.454.light.4.raw

SEQ ID NO: 582338 - DNA, 491 bp, Homo sapiens
  misc_feature: HIJSMM301AWNHY.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaacctggatatcagacgaactgtggctgca

SEQ ID NO: 582339 - DNA, 494 bp, Homo sapiens; identical to SEQ ID NO: 535276
  misc_feature: HIJSMM301A002X.16.6.A06.1.454.light.4.raw

SEQ ID NO: 582340 - DNA, 383 bp, Homo sapiens; identical to SEQ ID NO: 540698
  misc_feature: HIJSMM301ELNP1.41.28.C06.1.454.light.4.raw

SEQ ID NO: 582341 - DNA, 495 bp, Homo sapiens; identical to SEQ ID NO: 535007
  misc_feature: HIJSMM301D1MGL.22.5.A05.1.454.light.4.raw

SEQ ID NO: 582342 - DNA, 486 bp, Homo sapiens; identical to SEQ ID NO: 536261
  misc_feature: HIJSMM301EDFCH.26.55.E11.1.454.light.4.raw

SEQ ID NO: 582343 - DNA, 497 bp, Homo sapiens; identical to SEQ ID NO: 536376
  misc_feature: HIJSMM301BI833.22.9.A09.1.454.light.4.raw

SEQ ID NO: 582344 - DNA, 490 bp, Homo sapiens
  misc_feature: HIJSMM301CROQF.12.88.H11.1.454.light.4.raw
  modified_base (478)..(478): a, c, t, g, unknown or other
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcaggccgggtgggggctgaggatgttggcatttattctgcatgcaggctatacaccttcctgccacttttggccagggggaccaaggctgganatcaggcgaacg

SEQ ID NO: 582345 - DNA, 503 bp, Homo sapiens; identical to SEQ ID NO: 552003
  misc_feature: HIJSMM301AV36G.4.6.A06.1.454.light.4.raw

SEQ ID NO: 582346 - DNA, 460 bp, Homo sapiens
  misc_feature: HIJSMM301CT2ZD.49.8.A08.1.454.light.4.raw
agtcgagagacacgaccggtgctcgatttagcatactctacagggggtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 582347 - DNA, 489 bp, Homo sapiens
  misc_feature: HIJSMM301EA798.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatt

SEQ ID NO: 582348 - DNA, 499 bp, Homo sapiens
  misc_feature: HIJSMM301DYPE4.14.35.D02.1.454.light.4.raw
cgtctagtaccacgaccggtgctcgatttagcacacgatagttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtaccaacagaaaccaggacagtctcctaagttgctcattttctgggcatctacccgggaatccggggtccctgagcgattcagtggcagcgggtctgggacagatttcactttcaccatcagcagcctgcaggctgaagatgtggcagtttattactgtcagcaatattatagtactccctacacttttgccagggaccaagctggagatcaaacgaactgtggctgcaccta

SEQ ID NO: 582349 - DNA, 423 bp, Homo sapiens
  misc_feature: HIJSMM301DXYCR.9.34.D01.1.454.light.4.raw
tgatacgtctcacgaccggtgctcgatttagatcgtctgtgttgggtttgggggctgttcctggaagttgttggtaccagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactgggaccaaggtcaccgtcctgggtcagcccaaggccaaaccccactgtcactctgttcccgccctcctcagacgtatca

SEQ ID NO: 582350 - DNA, 503 bp, Homo sapiens
  misc_feature: HIJSMM301D7WOM.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatcaaaggaactgtggctgcaccatctgtcttcatcttcccgccta

SEQ ID NO: 582351 - DNA, 492 bp, Homo sapiens; identical to SEQ ID NO: 535126
  misc_feature: HIJSMM301AL9MV.18.11.A11.1.454.light.4.raw

SEQ ID NO: 582352 - DNA, 485 bp, Homo sapiens; identical to SEQ ID NO: 536576
  misc_feature: HIJSMM301ARV5L.46.35.D02.1.454.light.4.raw

SEQ ID NO: 582353 - DNA, 523 bp, Homo sapiens
  misc_feature: HIJSMM301B9LQH.49.26.C04.1.454.light.4.raw
agtcgagagacacgaccggtgctcgatttagtctagcgactttgggtttggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtcccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaaacataaaacacttgggtgttcggcggcgggaccaaactgaccgtcctacgtcagcccaaggctgccccctcggtcactctgttcccaccct

SEQ ID NO: 582354 - DNA, 464 bp, Homo sapiens; identical to SEQ ID NO: 536640
  misc_feature: HIJSMM301ANNW1.26.78.H01.1.454.light.4.raw

SEQ ID NO: 582355 - DNA, 502 bp, Homo sapiens; identical to SEQ ID NO: 535463
  misc_feature: HIJSMM301EH5GE.43.86.H09.1.454.light.4.raw

SEQ ID NO: 582356 - DNA, 463 bp, Homo sapiens; identical to SEQ ID NO: 540740
  misc_feature: HIJSMM301CH0S6.52.8.A08.1.454.light.4.raw

SEQ ID NO: 582357 - DNA, 497 bp, Homo sapiens; identical to SEQ ID NO: 536376
  misc_feature: HIJSMM301CICE2.22.9.A09.1.454.light.4.raw

SEQ ID NO: 582358 - DNA, 514 bp, Homo sapiens; identical to SEQ ID NO: 544770
  misc_feature: HIJSMM301CFADI.16.66.F11.1.454.light.4.raw

SEQ ID NO: 582359 - DNA, 506 bp, Homo sapiens
  misc_feature: HIJSMM301B4VXT.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaaggctgaccgtcctaggtcagcccaaggctgccccctcggtcactctgttcccgccctctcgctacgtaga

SEQ ID NO: 582360 - DNA, 498 bp, Homo sapiens
  misc_feature: HIJSMM301DFFBM.40.4.A04.1.454.light.4.raw
tctagcgactcacgaccggtgctcgatttagagtagtgatcagggggagctacaacaggcaggcaggggcagcaagatggtgttgcagacccaggtcttcatttctctgttcctctggatctctggtgccttcggggacatcgtgatgacccagtctccagactccctggctctgtctctgggcgagagggccaccatcaactgcaagtccagccagagcgttttatccacttcctacaatcagaattacttagcttggtatcagcataaaccagggcagcctccgaggctgctcatttactggacatctatccgggaatccggggtccctgaccgattccgtggcagtgggtctgggacagattttactctcaccatcaccagccttcaggctgaagatgtggcagtttattactgtcaccaatatttagacattcctccgacgttcggccaagggaccaaggtggagatcaaacgaactgtggctgcaccatctgt

SEQ ID NO: 582361 - DNA, 494 bp, Homo sapiens
  misc_feature: HIJSMM301BSLI2.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcactttcggcggggggaccaaggtggagttcaaacgaactgtggctgcaccatctgtcttcatt

SEQ ID NO: 582362 - DNA, 450 bp, Homo sapiens
  misc_feature: HIJSMM301A1SDW.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggccccttgacaacagttttggggtgttttggggtgttcgggcggagggaccaagctgaccgtcctaagtcagcccaaggctgccccctcggtcactctgttcccgccctcctccgtgtctgat

SEQ ID NO: 582363 - DNA, 504 bp, Homo sapiens
  misc_feature: HIJSMM301DK0T4.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcactc

SEQ ID NO: 582364 - DNA, 493 bp, Homo sapiens
  misc_feature: HIJSMM301C4ZWA.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttatactgtcagcagtataataactggttcctgctcactttcggcgggggaccgaaggtggagatcaaacgaactgtggctgcaccatctgtt

SEQ ID NO: 582365 - DNA, 500 bp, Homo sapiens
  misc_feature: HIJSMM301BK6FQ.51.24.C02.1.454.light.4.raw
cgatcgtatacacgaccggtgctcgatttagtacagatcgttagggaaaggggtgatcaggactcctcagttcaccttctcacaatgaggctccctgctcagctcctggggctgctaatgctctgggtcccagcatccagtggagatgttgtgctgactcagtctccactctccctgtccgtcacccttggacagccagcttccatctcctgcaggtctagtcaaagcctcgtttatagtgttggaaacacctacttgaattggtttcatcagaggccgggccaatctccaaggcgcctgatttataaggtttctaaccgggactctggggtcccagacagattcagcggcagtgggtcaggcactcatttcacactgaggatcagcagggtggaggctgaggatgttggggtttattactgcatgcaaggtacacactggcctcctatcaccttcggccaagggacacgactggaggttaaacgaactgtggctgcacc

SEQ ID NO: 582366 - DNA, 496 bp, Homo sapiens
  misc_feature: HIJSMM301E3FVM.48.1.A01.1.454.light.4.raw
agtatacatacacgaccggtgctcgatttagacgtctcatcaggggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaaactgtggctgcaccatctgtcttcatcttcccg

SEQ ID NO: 582367 - DNA, 490 bp, Homo sapiens; identical to SEQ ID NO: 577623
  misc_feature: HIJSMM301AVRHX.49.42.D09.1.454.light.4.raw

SEQ ID NO: 582368 - DNA, 494 bp, Homo sapiens; identical to SEQ ID NO: 539922
  misc_feature: HIJSMM301CN4Q5.27.78.H01.1.454.light.4.raw

SEQ ID NO: 582369 - DNA, 497 bp, Homo sapiens; identical to SEQ ID NO: 535286
  misc_feature: HIJSMM301EME9X.18.59.F04.1.454.light.4.raw

SEQ ID NO: 582370 - DNA, 503 bp, Homo sapiens
  misc_feature: HIJSMM301CU00A.48.67.G01.1.454.light.4.raw
agtatacatacacgaccggtgctcgatttagagtatacatattgggtttggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgactgtggctgcaccatctgtcttcatcttccccg

SEQ ID NO: 582371 - DNA, 488 bp, Homo sapiens; identical to SEQ ID NO: 537260
  misc_feature: HIJSMM301BCJLG.47.70.G04.1.454.light.4.raw

SEQ ID NO: 582372 - DNA, 490 bp, Homo sapiens
  misc_feature: HIJSMM301AE2Y9.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctcgggaccgaaacgtggatatcaaacgaactagtggctgcaccatctgtt

SEQ ID NO: 582373 - DNA, 475 bp, Homo sapiens
  misc_feature: HIJSMM301EEU7W.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttacctcccactttcggcggagggaccaaggtggagatcaaacgaactgtggctgcaccatctgt

SEQ ID NO: 582374 - DNA, 488 bp, Homo sapiens
  misc_feature: HIJSMM301CNTV2.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggcctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggcctgccccctggtcactctgttcccgccctcctc

SEQ ID NO: 582375 - DNA, 493 bp, Homo sapiens; identical to SEQ ID NO: 537422
  misc_feature: HIJSMM301AWACC.9.34.D01.1.454.light.4.raw

SEQ ID NO: 582376 - DNA, 508 bp, Homo sapiens
  misc_feature: HIJSMM301ATT4T.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcaggacaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtaggaagtacaagacgaactagtggcgtgcgaccactctgtcttctactt

SEQ ID NO: 582377 - DNA, 486 bp, Homo sapiens; identical to SEQ ID NO: 537617
  misc_feature: HIJSMM301CT1MZ.10.53.E09.1.454.light.4.raw

SEQ ID NO: 582378 - DNA, 495 bp, Homo sapiens
  misc_feature: HIJSMM301CBWD6.19.25.C03.1.454.light.4.raw
tactctcgtgcacgaccggtgctcgatttagtagtgtagatttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagtttattactgtcagcagtataataactggcctcagactttcggcgggagggaccgaaggtggagatacaaacgaactgtggctgcaccatctgtt

SEQ ID NO: 582379 - DNA, 522 bp, Homo sapiens; identical to SEQ ID NO: 543470
  misc_feature: HIJSMM301CQ6AS.5.27.C05.1.454.light.4.raw

SEQ ID NO: 582380 - DNA, 454 bp, Homo sapiens; identical to SEQ ID NO: 535005
  misc_feature: HIJSMM301B2EXT.19.86.H09.1.454.light.4.raw

SEQ ID NO: 582381 - DNA, 434 bp, Homo sapiens; identical to SEQ ID NO: 536762
  misc_feature: HIJSMM301D5ULS.48.1.A01.1.454.light.4.raw

SEQ ID NO: 582382 - DNA, 481 bp, Homo sapiens
  misc_feature: HIJSMM301B1UQE.51.60.F05.1.454.light.4.raw
  modified_base (404)..(404): a, c, t, g, unknown or other
cgatcgtatacacgaccggtgctcgatttagtacgtcatcagggaaaggggctgggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttacngtcaggcgtgggacagcgacactgccgtgttcggcggagggaccaagctgaccgtcctcggtcagcccaaggctccg

SEQ ID NO: 582383 - DNA, 505 bp, Homo sapiens
  misc_feature: HIJSMM301BDPWG.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggcctgccccctcggtcta

SEQ ID NO: 582384 - DNA, 508 bp, Homo sapiens
  misc_feature: HIJSMM301C2GZM.47.55.E11.1.454.light.4.raw
  modified_base (473)..(473): a, c, t, g, unknown or other
agctcacgtacacgaccggtgctcgatttagcactcgcacgttgggtttggggggggaagctcagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcgganctgggaccaaggtcaccgtcctaggtcagcccaac

SEQ ID NO: 582385 - DNA, 517 bp, Homo sapiens; identical to SEQ ID NO: 557449
  misc_feature: HIJSMM301AROM8.9.2.A02.1.454.light.4.raw

SEQ ID NO: 582386 - DNA, 489 bp, Homo sapiens
  misc_feature: HIJSMM301BF9R2.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcagcccaaggctgtccccccg

SEQ ID NO: 582387 - DNA, 511 bp, Homo sapiens
  misc_feature: HIJSMM301AS5JI.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgcctcct

SEQ ID NO: 582388 - DNA, 484 bp, Homo sapiens
  misc_feature: HIJSMM301D2FKU.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtgctgcac

SEQ ID NO: 582389 - DNA, 485 bp, Homo sapiens
  misc_feature: HIJSMM301DIPIQ.40.21.B10.1.454.light.4.raw
tctagcgactcacgaccggtgctcgatttagtgtcgtcgcaaggggtggatcaggactcctcagttcaccttctcacaatgaggctccctgctcagctcctggggctgctaatgctctgggtcccagaattcagtggggatgttgtgatgactcagtctccactctccctgcccgtcacccttggacagccggcctccatctcctgcaggtctagtcaaagcctcactcgcagtgatggaagcacctacttgaattggtttcacccagaggccaggccaatctccgaggcgcctaatttcgtgaggtttctaaccgcgactctggggtcccagacagattcagcggcagtgggtcaggcactgatttcacactgaaatcagcagggtggaggctgaggatgttgggatttatactgcatgcaaggttcacactggcctccgatacacttttggcctaggggaccgaagctggagatcaaaccgaa

SEQ ID NO: 582390 - DNA, 487 bp, Homo sapiens; identical to SEQ ID NO: 539157
  misc_feature: HIJSMM301ESOFY.26.37.D04.1.454.light.4.raw

SEQ ID NO: 582391 - DNA, 480 bp, Homo sapiens
  misc_feature: HIJSMM301D89V5.40.48.E04.1.454.light.4.raw
tctagcgactcacgaccggtgctcgatttagagagcgtcacagagagaagggggaagtctctctcagtcaggacacagcatggacatgagggtccctgctcagctcctgggactcctgctgctctggctcccagatactagatgtgacatccagatgacccagtctccaccctccctgtctgcatctgtcggagacaaagtcaccatcacttgccgggcgagtcaagtcattagcaattatttagcctggtatcagcagaaaccagggcaaggtcctaaactcctgatctacgctgcatccactttgcactcaggggtcccatctcggttcaccggcagtggatctgggacaggatttcactctcatcatcagcagcctgcagcctgaggatgttgcaacttattactgtcaaaagtataacattgccccctttcaccttcggccaaggggacacggactggagattaaacgaactgtgg

SEQ ID NO: 582392 - DNA, 503 bp, Homo sapiens; identical to SEQ ID NO: 571958
  misc_feature: HIJSMM301DG9DI.2.76.G10.1.454.light.4.raw
  modified_base (462)..(462): a, c, t, g, unknown or other

SEQ ID NO: 582393 - DNA, 486 bp, Homo sapiens; identical to SEQ ID NO: 537144
  misc_feature: HIJSMM301DPEZI.46.35.D02.1.454.light.4.raw

SEQ ID NO: 582394 - DNA, 496 bp, Homo sapiens; identical to SEQ ID NO: 549405
  misc_feature: HIJSMM301DNQ7O.3.71.G05.1.454.light.4.raw

SEQ ID NO: 582395 - DNA, 504 bp, Homo sapiens
  misc_feature: HIJSMM301EYRK9.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcacgggacgcaacatgggatgacaatctgagcggttgggtgttcggcggagggaccaaactgaccgtcctaggtcaggcccaa

SEQ ID NO: 582396 - DNA, 498 bp, Homo sapiens; identical to SEQ ID NO: 547944
  misc_feature: HIJSMM301BS6VV.41.53.E09.1.454.light.4.raw

SEQ ID NO: 582397 - DNA, 495 bp, Homo sapiens; identical to SEQ ID NO: 538673
  misc_feature: HIJSMM301DF3LP.51.35.D02.1.454.light.4.raw

SEQ ID NO: 582398 - DNA, 504 bp, Homo sapiens; identical to SEQ ID NO: 570066
  misc_feature: HIJSMM301CEWF5.52.37.D04.1.454.light.4.raw

SEQ ID NO: 582399 - DNA, 517 bp, Homo sapiens; identical to SEQ ID NO: 536980
  misc_feature: HIJSMM301C03AJ.5.27.C05.1.454.light.4.raw

SEQ ID NO: 582400 - DNA, 478 bp, Homo sapiens
  misc_feature: HIJSMM301AELAG.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaaccagggaaagccctaagctcctgatctacgatgcatctaagttggaaacaggggtctcatcaaggttcagtggaagtggatctgggacagatcctactttcaccatcagcagcctgcagccagaagatattgcgacatatttctgtcaggtgtatgaaagtctcccttgtttttggtccaggggaccgaaggtggagatacaaacgaactagtggctgcaccat

SEQ ID NO: 582401 - DNA, 509 bp, Homo sapiens
  misc_feature: HIJSMM301BCXA5.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggggacccaaagtggaaatcaaacgaactgtggctgcaccatctgtcttcatcttcccgcc

SEQ ID NO: 582402 - DNA, 489 bp, Homo sapiens; identical to SEQ ID NO: 537328
  misc_feature: HIJSMM301B1A7E.13.5.A05.1.454.light.4.raw

SEQ ID NO: 582403 - DNA, 478 bp, Homo sapiens
  misc_feature: HIJSMM301D6ZQS.48.49.E05.1.454.light.4.raw
agtatacatacacgaccggtgctcgatttagagcgactagcaacacacaaaggggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgtagcctgaagattctgcaacttattactgtctacacgattacaattaccctcgtacgttcggccaagggaccaaggtggaaatcaaacgaactgtgg

SEQ ID NO: 582404 - DNA, 494 bp, Homo sapiens
  misc_feature: HIJSMM301CU59C.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccagggaccaagctggagatcaaacgaactgtggcg

SEQ ID NO: 582405 - DNA, 506 bp, Homo sapiens; identical to SEQ ID NO: 553862
  misc_feature: HIJSMM301B8A12.10.88.H11.1.454.light.4.raw

SEQ ID NO: 582406 - DNA, 494 bp, Homo sapiens; identical to SEQ ID NO: 535680
  misc_feature: HIJSMM301CMJNU.16.78.H01.1.454.light.4.raw

SEQ ID NO: 582407 - DNA, 490 bp, Homo sapiens; identical to SEQ ID NO: 541141
  misc_feature: HIJSMM301BH43D.47.38.D05.1.454.light.4.raw

SEQ ID NO: 582408 - DNA, 494 bp, Homo sapiens; identical to SEQ ID NO: 535629
  misc_feature: HIJSMM301CJ0HC.4.27.C05.1.454.light.4.raw

SEQ ID NO: 582409 - DNA, 513 bp, Homo sapiens
  misc_feature: HIJSMM301CSBT5.17.33.C11.1.454.light.4.raw
  modified_base (506)..(506): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtgtgctgtgctattcggcggagggaccaagctgaccgtcttaagtcagcccaaggctgccccctcggtcactctgttcccnccctcct

SEQ ID NO: 582410 - DNA, 485 bp, Homo sapiens
  misc_feature: HIJSMM301AU6ZV.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccgaacggtggaaagtacaaacgaactagtggctgcacca

SEQ ID NO: 582411 - DNA, 493 bp, Homo sapiens; identical to SEQ ID NO: 535084
  misc_feature: HIJSMM301BTY2U.47.64.F09.1.454.light.4.raw

SEQ ID NO: 582412 - DNA, 500 bp, Homo sapiens
  misc_feature: HIJSMM301BDB1O.12.11.A11.1.454.light.4.raw
  modified_base (419)..(419): a, c, t, g, unknown or other
atacgacgtacacgaccggtgctcgatttagctacgactgcaggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggcaaaaaacggccctcggggagtttctaatcgcttctctggctccaagtctggcaacacggcctccctgacaatctctgggctccaggctgaggacgaggctgattattactgctgctcntaatgcaggtagtggcactttcgcactattcggcggagggaccaagctgaccgtcctacgtcagcccaaggctgccccccg

SEQ ID NO: 582413 - DNA, 517 bp, Homo sapiens
  misc_feature: HIJSMM301B7O4Z.52.34.D01.1.454.light.4.raw
  modified_base (508)..(508): a, c, t, g, unknown or other
cgcagtacgacacgaccggtgctcgatttagatcgtctgtgttgggtttgggggatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcgggtggaggctgaggatgttggggtttattactgcatgcaaggtacacactggcctccgacgttcggccaagggaccgaaggtggaaatacaaacgaactgtggctgcaccatctgtcttcntcttccccg

SEQ ID NO: 582414 - DNA, 494 bp, Homo sapiens; identical to SEQ ID NO: 559643
  misc_feature: HIJSMM301AO3FD.27.78.H01.1.454.light.4.raw

SEQ ID NO: 582415 - DNA, 493 bp, Homo sapiens; identical to SEQ ID NO: 535047
  misc_feature: HIJSMM301EZFCG.16.53.E09.1.454.light.4.raw

SEQ ID NO: 582416 - DNA, 490 bp, Homo sapiens
  misc_feature: HIJSMM301CBWG0.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtcaagcgaactgtggcgtgcaccact

SEQ ID NO: 582417 - DNA, 495 bp, Homo sapiens; identical to SEQ ID NO: 557898
  misc_feature: HIJSMM301B9RWJ.12.38.D05.1.454.light.4.raw

SEQ ID NO: 582418 - DNA, 511 bp, Homo sapiens
  misc_feature: HIJSMM301BGCMP.43.3.A03.1.454.light.4.raw
tgtgagtagtcacgaccggtgctcgatttagagagcgtcacagggggtggtagctcaggaagcagagcctggagcatctccactatggcctgggctccactacttctcaccctcctcgctcactgcacaggttcttgggccagttttatgctgactcagccccactctgtgtcggagtctccggggaagacggtaaccatctcctgcacccgcagcggtggctttattgccagcaataatatgcagtggtaccagcagcgcccgggcacgtcccccaccactgtgatctatgaggatgaccaaagaccctctggggtccctaatcggttctctggctccgtcgacacctcctccaactctgcctacctcaccatctctggactgaagactgaggacgaggctgactattactgtcactcttatgatcgcaacaacagggtgttcggcggagggaccaggttgaccgtccttggtcagcccaaggctgccccctcggtcactctgttccccg

SEQ ID NO: 582419 - DNA, 508 bp, Homo sapiens
  misc_feature: HIJSMM301AUSC8.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaacgggaccgaaggtgggaaatacaaaacgaaacctagtggctgcaccatctgtcttcatcttt

SEQ ID NO: 582420 - DNA, 505 bp, Homo sapiens
  misc_feature: HIJSMM301CUZXO.40.67.G01.1.454.light.4.raw
  modified_base (396)..(396): a, c, t, g, unknown or other
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaagcctggccaggctcccagactcctcatctatgatgcgtcttccagggccactggcgtcccggccaggttcagtggcagtgggtctgggacagccttcactctcaccatcagcagcctggagcccgaagattttgnggtttattactgtcagcagcgtgccgactggccccctcacgttcggcggagggaccaaggtggacatcaaacgaactgtggctgcaccatctgtcttcatcttcccgcc

SEQ ID NO: 582421 - DNA, 487 bp, Homo sapiens
  misc_feature: HIJSMM301CHFXA.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctaatcggagcctcctccatagtgatggaaagacctatttgtattggtacctgcagaaggcaggccagtctccacacctcctaatctatgaggtttccagccgttctctggagtgccagaaaggttcagtggcagcgggtcagggacagatttcacactgaaaatcagccgggtgggggcgtgaggatgttggcatttattactgcatgcaggctatacaccttccttgccacttttggccaggggaccaagctggagatcaggcgaa

SEQ ID NO: 582422 - DNA, 517 bp, Homo sapiens
  misc_feature: HIJSMM301DOG2R.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaacggaccgaacggtaggaaggtacaaacgaactacgtggctgcaccatctgtcttctactcttcccgtcccact

SEQ ID NO: 582423 - DNA, 495 bp, Homo sapiens; identical to SEQ ID NO: 537415
  misc_feature: HIJSMM301CTY33.4.27.C05.1.454.light.4.raw

SEQ ID NO: 582424 - DNA, 492 bp, Homo sapiens; identical to SEQ ID NO: 536010
  misc_feature: HIJSMM301AUV8I.10.20.B09.1.454.light.4.raw

SEQ ID NO: 582425 - DNA, 481 bp, Homo sapiens
  misc_feature: HIJSMM301EXGCM.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaaggaccaaggtggaagtcaaacgaactagtggctgcaccat

SEQ ID NO: 582426 - DNA, 444 bp, Homo sapiens; identical to SEQ ID NO: 537971
  misc_feature: HIJSMM301EGVH5.2.76.G10.1.454.light.4.raw

SEQ ID NO: 582427 - DNA, 502 bp, Homo sapiens; identical to SEQ ID NO: 535463
  misc_feature: HIJSMM301B3Y84.43.86.H09.1.454.light.4.raw

SEQ ID NO: 582428 - DNA, 503 bp, Homo sapiens; identical to SEQ ID NO: 535140
  misc_feature: HIJSMM301BIYN9.18.37.D04.1.454.light.4.raw

SEQ ID NO: 582429 - DNA, 482 bp, Homo sapiens
  misc_feature: HIJSMM301EGM0R.4.19.B08.1.454.light.4.raw
agcactgtagcacgaccggtgctcgatttagtgagtcagtaagggggagtcagactcagtcaggacacagcatggacatgagggtccccgctcagctcctggggctcctgctgctctggctcccaggagccgattgtgacatccagttgacccagtctccctccaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtataattagttattggacgttcggccaggggaccaaggtggaattcaaacgaactgtggctgcaccatctgtctt

SEQ ID NO: 582430 - DNA, 507 bp, Homo sapiens
  misc_feature: HIJSMM301A59CF.48.14.B03.1.454.light.4.raw
agtatacatacacgaccggtgctcgatttagtgtgagtagttccgcgggggggcacttctccctctaacactctcccctgttgaagctctttgtgacgggcgagctcaggccctgatgggtgacttcgcaggcgtagactttgtgtttctcgtagtctgctttgctcagcgtcagggtgctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctgggtcccagacagattcagcggcagtgggtcagacactgacttcacactgagaatcagcagggttgaggctgaggatgttggcacttattactgcatgcaaggctcacactc

SEQ ID NO: 582431 - DNA, 488 bp, Homo sapiens
  misc_feature: HIJSMM301DDM57.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacgaact

SEQ ID NO: 582432 - DNA, 502 bp, Homo sapiens
  misc_feature: HIJSMM301D60HO.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttagttactgcatgcaagctctacaaactccttacacttttggtccaggggaccgaacgctggaggatcaaacgaactagtggtcg

SEQ ID NO: 582433 - DNA, 503 bp, Homo sapiens
  misc_feature: HIJSMM301ANA64.19.78.H01.1.454.light.4.raw
  modified_base (498)..(499): a, c, t, g, unknown or other
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaacccnngtca

SEQ ID NO: 582434 - DNA, 506 bp, Homo sapiens; identical to SEQ ID NO: 563474
  misc_feature: HIJSMM301EZ6LA.10.27.C05.1.454.light.4.raw

SEQ ID NO: 582435 - DNA, 504 bp, Homo sapiens
  misc_feature: HIJSMM301B36S7.52.27.C05.1.454.light.4.raw
cgcagtacgacacgaccggtgctcgatttagacgcgatcgaagggtttgggggagtcagtctcagtcaggacacagcatggacatgagggtccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtccctcaaggttcagtggccgtggatctgggacagatttcactctcaccatcagcagtctccaacctgaagattttgcaatttactactgtcaacagagtgacaatacccctcagactttcggtccctcgggaccgagaggtaggatatacaaacgaaacctagttggcgtgcaacccatactgttctt

SEQ ID NO: 582436 - DNA, 463 bp, Homo sapiens
  misc_feature: HIJSMM301ECUJS.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctggagatattgcaacatattactgtcaacagtatgatcgtctcctcaatttcggccctgggaccagagtggacatgaaacgaa

SEQ ID NO: 582437 - DNA, 480 bp, Homo sapiens; identical to SEQ ID NO: 547229
  misc_feature: HIJSMM301D6U3X.12.10.A10.1.454.light.4.raw

SEQ ID NO: 582438 - DNA, 504 bp, Homo sapiens
  misc_feature: HIJSMM301DGGQY.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctggggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcccctcctgaccatcagtgggctccggtccgaggatgaggctgactatactgtgcatcacgggacgcaacatgggatgacaatctgagcgggttggtgttcggcggagggaccaaactgaccgtcctaggtcaggcccaa

SEQ ID NO: 582439 - DNA, 509 bp, Homo sapiens
  misc_feature: HIJSMM301CE4RV.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtccactctgtt

SEQ ID NO: 582440 - DNA, 509 bp, Homo sapiens
  misc_feature: HIJSMM301DHCG5.21.22.B11.1.454.light.4.raw
tcgtcgctcgcacgaccggtgctcgatttagacgacagctcagggtggggtcaaaaacccggggagggggtctgatttgcatggatggactctccccctctcagagtacgaagagagggagagatctgggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatcggcccccaaactcctcatccagaggaataatcagcggccctcaggggtccctgaccgattctctggctccaagtctggcacctcagcctccctgaccatcagtcgggcctccggtccgaggatgaggctgactattact

SEQ ID NO: 582441 - DNA, 509 bp, Homo sapiens
  misc_feature: HIJSMM301BTCWH.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccaaggtcggaaagtcaaacgaaacctgtggctggcaccatctgtcttctatcttccccg

SEQ ID NO: 582442 - DNA, 486 bp, Homo sapiens
  misc_feature: HIJSMM301BA00G.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggaggaccgacggtggagatacaaacgaactagtgctgcacactctgtcttcta

SEQ ID NO: 582443 - DNA, 484 bp, Homo sapiens; identical to SEQ ID NO: 547458
  misc_feature: HIJSMM301BYM13.15.1.A01.1.454.light.4.raw

SEQ ID NO: 582444 - DNA, 494 bp, Homo sapiens; identical to SEQ ID NO: 534992
  misc_feature: HIJSMM301CGH61.9.1.A01.1.454.light.4.raw

SEQ ID NO: 582445 - DNA, 488 bp, Homo sapiens; identical to SEQ ID NO: 540389
  misc_feature: HIJSMM301AW9B9.9.75.G09.1.454.light.4.raw

SEQ ID NO: 582446 - DNA, 502 bp, Homo sapiens
  misc_feature: HIJSMM301AFO1N.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttacctcaagtgatccaccttcggccgaaagggaccacgacgtggagaattaaacgaactgtggctgccaccatctgtctt

SEQ ID NO: 582447 - DNA, 499 bp, Homo sapiens
  misc_feature: HIJSMM301BVPMR.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgcccctcggtcact

SEQ ID NO: 582448 - DNA, 486 bp, Homo sapiens; identical to SEQ ID NO: 535043
  misc_feature: HIJSMM301A77W2.46.35.D02.1.454.light.4.raw

SEQ ID NO: 582449 - DNA, 494 bp, Homo sapiens; identical to SEQ ID NO: 534994
  misc_feature: HIJSMM301BJJHH.27.78.H01.1.454.light.4.raw

SEQ ID NO: 582450 - DNA, 503 bp, Homo sapiens; identical to SEQ ID NO: 537189
  misc_feature: HIJSMM301DQN1L.19.85.H08.1.454.light.4.raw

SEQ ID NO: 582451 - DNA, 444 bp, Homo sapiens; identical to SEQ ID NO: 537971
  misc_feature: HIJSMM301EKM9A.2.76.G10.1.454.light.4.raw

SEQ ID NO: 582452 - DNA, 494 bp, Homo sapiens
  misc_feature: HIJSMM301B1S53.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggccaaagtaggagatcaacgaaactgtggctgcaccatctgtctt

SEQ ID NO: 582453 - DNA, 492 bp, Homo sapiens
  misc_feature: HIJSMM301CA7XG.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcaggtgggtctggaacagagttcactctcaccatcagcggcctgcagtctgaagattttgcagtttattactgtcagcagtataatgactgggttttattcactttcggccctgggaccaaagtggatttcagacgaactgtggctgcacatctgtcttcta

SEQ ID NO: 582454 - DNA, 502 bp, Homo sapiens; identical to SEQ ID NO: 536253
  misc_feature: HIJSMM301A0KKN.21.22.B11.1.454.light.4.raw

SEQ ID NO: 582455 - DNA, 498 bp, Homo sapiens; identical to SEQ ID NO: 535974
  misc_feature: HIJSMM301BI7BA.22.27.C05.1.454.light.4.raw

SEQ ID NO: 582456 - DNA, 488 bp, Homo sapiens
  misc_feature: HIJSMM301CXZ7K.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaaggctggagatcaaacgaa

SEQ ID NO: 582457 - DNA, 522 bp, Homo sapiens
  misc_feature: HIJSMM301ADWKW.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagtattttgctagtttattactgtcagcagcgtgccactttcggcggaggtgcctactttcggtcgggacgggaaccgaaatagaggtacgaaacgaactagtggcgtgcgaccactctgttcttctacttcccg

SEQ ID NO: 582458 - DNA, 478 bp, Homo sapiens
  misc_feature: HIJSMM301C4O3V.49.82.H05.1.454.light.4.raw
agtcgagagacacgaccggtgctcgatttagtcgagctctctcgcgggcacgaccggtgctcgatttagagtagtgatcaggggcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggaaacagggtcccatcaaggttcagtggaagtggctctgggacagattttactttctaccatcagcaggctgcagcctgaagatattgcaacatattactgtcaacagtatgatagtctcccgctcactttcggcgggggtaccg

SEQ ID NO: 582459 - DNA, 477 bp, Homo sapiens
  misc_feature: HIJSMM301B8VLG.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgcctcggactgaagtagcatatgaagaagaactagtggctgca

SEQ ID NO: 582460 - DNA, 509 bp, Homo sapiens; identical to SEQ ID NO: 535670
  misc_feature: HIJSMM301D7VVA.47.23.C01.1.454.light.4.raw

SEQ ID NO: 582461 - DNA, 515 bp, Homo sapiens; identical to SEQ ID NO: 550125
  misc_feature: HIJSMM301BJT58.43.19.B08.1.454.light.4.raw

SEQ ID NO: 582462 - DNA, 483 bp, Homo sapiens
  misc_feature: HIJSMM301C3PJ3.40.83.H06.1.454.light.4.raw
tctagcgactcacgaccggtgctcgatttagatcacgtgcgtcgcgggaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgtgaacacagcctccctgaccatcactggactcaagcctgaggacgaggctgactattactgttcagcatgggacggcagcctcagtgaatggtgttcggcggagggaccaaactgtccgtctaggtcacgcccaac

SEQ ID NO: 582463 - DNA, 483 bp, Homo sapiens; identical to SEQ ID NO: 555750
  misc_feature: HIJSMM301DI6WS.41.78.H01.1.454.light.4.raw

SEQ ID NO: 582464 - DNA, 512 bp, Homo sapiens
  misc_feature: HIJSMM301AZVQ1.3.87.H10.1.454.light.4.raw
agacgcactccacgaccggtgctcgatttagcagtactgcgttgggtttggggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgcttattactgcagctcatatacaaggagcaccactctcgtggtatttggtggagggaccaagctgaccgtcctaggtcagcccaaggctgccccctggt

SEQ ID NO: 582465 - DNA, 507 bp, Homo sapiens
  misc_feature: HIJSMM301EQGHB.48.87.H10.1.454.light.4.raw
  modified_base (235)..(235): a, c, t, g, unknown or other
agtatacatacacgaccggtgctcgatttagcagtactgcgttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatntgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtcactctgttccccg

SEQ ID NO: 582466 - DNA, 478 bp, Homo sapiens; identical to SEQ ID NO: 535129
  misc_feature: HIJSMM301A0BOM.11.11.A11.1.454.light.4.raw

SEQ ID NO: 582467 - DNA, 486 bp, Homo sapiens; identical to SEQ ID NO: 535043
  misc_feature: HIJSMM301CAMCR.46.35.D02.1.454.light.4.raw

SEQ ID NO: 582468 - DNA, 494 bp, Homo sapiens; identical to SEQ ID NO: 534992
  misc_feature: HIJSMM301BF7PD.9.1.A01.1.454.light.4.raw

SEQ ID NO: 582469 - DNA, 517 bp, Homo sapiens
  misc_feature: HIJSMM301CGMX1.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagccaaggctgccccctcggtcactctgttcccaccctcctccacg

SEQ ID NO: 582470 - DNA, 482 bp, Homo sapiens; identical to SEQ ID NO: 535920
  misc_feature: HIJSMM301AVU0M.19.71.G05.1.454.light.4.raw

SEQ ID NO: 582471 - DNA, 490 bp, Homo sapiens; identical to SEQ ID NO: 538273
  misc_feature: HIJSMM301EL0RN.16.73.G07.1.454.light.4.raw

SEQ ID NO: 582472 - DNA, 501 bp, Homo sapiens
  misc_feature: HIJSMM301AN72V.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaagtaggagatcaaacgaactgtggctgcaccatctgtcttcta

SEQ ID NO: 582473 - DNA, 495 bp, Homo sapiens; identical to SEQ ID NO: 535821
  misc_feature: HIJSMM301BGGEO.3.31.C09.1.454.light.4.raw

SEQ ID NO: 582474 - DNA, 488 bp, Homo sapiens; identical to SEQ ID NO: 540342
  misc_feature: HIJSMM301BY5PS.43.33.C11.1.454.light.4.raw

SEQ ID NO: 582475 - DNA, 508 bp, Homo sapiens
  misc_feature: HIJSMM301EI54N.48.15.B04.1.454.light.4.raw
  modified_base (402)..(402): a, c, t, g, unknown or other
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaanatgtggcagtttattactgttcaacaatattattctactccgccgacgttcgccggggaccaacgtggaaatcaaacgaactagtggctgcaccatctgtcttcta

SEQ ID NO: 582476 - DNA, 478 bp, Homo sapiens; identical to SEQ ID NO: 555043
  misc_feature: HIJSMM301CG5LA.52.1.A01.1.454.light.4.raw

SEQ ID NO: 582477 - DNA, 510 bp, Homo sapiens; identical to SEQ ID NO: 541797
  misc_feature: HIJSMM301B3H0S.15.34.D01.1.454.light.4.raw

SEQ ID NO: 582478 - DNA, 447 bp, Homo sapiens; identical to SEQ ID NO: 535020
  misc_feature: HIJSMM301EDGHY.18.9.A09.1.454.light.4.raw

SEQ ID NO: 582479 - DNA, 422 bp, Homo sapiens
  misc_feature: HIJSMM301D46K9.41.82.H05.1.454.light.4.raw
tctatactatcacgaccggtgctcgatttagtcgagctctctcgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttccccgccatctgaatagtataga

SEQ ID NO: 582480 - DNA, 498 bp, Homo sapiens
  misc_feature: HIJSMM301EIK6P.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgtgaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatcaaacgaactgtggctgcacc

SEQ ID NO: 582481 - DNA, 489 bp, Homo sapiens; identical to SEQ ID NO: 535139
  misc_feature: HIJSMM301ATGST.14.55.E11.1.454.light.4.raw

SEQ ID NO: 582482 - DNA, 514 bp, Homo sapiens
  misc_feature: HIJSMM301BHNGD.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggcccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctcggtcactctgttcccgccctcct

SEQ ID NO: 582483 - DNA, 485 bp, Homo sapiens; identical to SEQ ID NO: 535501
  misc_feature: HIJSMM301DJ4KE.3.10.A10.1.454.light.4.raw

SEQ ID NO: 582484 - DNA, 491 bp, Homo sapiens
  misc_feature: HIJSMM301A7UJN.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatcctacttttggccaagggaccaagctggagatcaaacgaactgtggctgcaccta

SEQ ID NO: 582485 - DNA, 497 bp, Homo sapiens
  misc_feature: HIJSMM301C7O5F.51.87.H10.1.454.light.4.raw
cgatcgtatacacgaccggtgctcgatttagcagtactgcgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaaacagacaccattggtacttatgtcttcggaactgcgaccaaggtcaccgtcctgggtcagcccaaggccaacccactgtcactc

SEQ ID NO: 582486 - DNA, 519 bp, Homo sapiens
  misc_feature: HIJSMM301B8TMT.9.2.A02.1.454.light.4.raw
  modified_base (515)..(515): a, c, t, g, unknown or other
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtccactctcgttcccnccct

SEQ ID NO: 582487 - DNA, 481 bp, Homo sapiens; identical to SEQ ID NO: 535993
  misc_feature: HIJSMM301A3RYD.21.25.C03.1.454.light.4.raw

SEQ ID NO: 582488 - DNA, 486 bp, Homo sapiens; identical to SEQ ID NO: 552805
  misc_feature: HIJSMM301CJT8Q.3.10.A10.1.454.light.4.raw

SEQ ID NO: 582489 - DNA, 512 bp, Homo sapiens; identical to SEQ ID NO: 541300
  misc_feature: HIJSMM301CYVLI.17.33.C11.1.454.light.4.raw

SEQ ID NO: 582490 - DNA, 485 bp, Homo sapiens
  misc_feature: HIJSMM301EP60G.47.46.E02.1.454.light.4.raw
agctcacgtacacgaccggtgctcgatttagactcatctacagggaaaggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgaactgtggctgcaccat

SEQ ID NO: 582491 - DNA, 489 bp, Homo sapiens; identical to SEQ ID NO: 548452
  misc_feature: HIJSMM301DCXA2.26.37.D04.1.454.light.4.raw

SEQ ID NO: 582492 - DNA, 508 bp, Homo sapiens
  misc_feature: HIJSMM301EEXI6.26.26.C04.1.454.light.4.raw
agactatactcacgaccggtgctcgatttagtctagcgactttgggtttggggctgatcaggactcctcagttcaccttctcacaatgaggcctccctgctcagctcctggggctgctaatgctctgggtcccagggtccaggtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggaccgttcggccgaagggaccgaaggtggaaatacaaacgaactgtggctgcaccattc

SEQ ID NO: 582493 - DNA, 496 bp, Homo sapiens
  misc_feature: HIJSMM301DHRW8.27.78.H01.1.454.light.4.raw
agcgtcgtctcacgaccggtgctcgatttagtgtgagtagtttgggtttggggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttacctcaagtgatcaccttcggccaagggacacgactggagattaaacgaactgtggctgcaccatctgtt

SEQ ID NO: 582494 - DNA, 487 bp, Homo sapiens; identical to SEQ ID NO: 539440
  misc_feature: HIJSMM301C78C4.8.12.B01.1.454.light.4.raw

SEQ ID NO: 582495 - DNA, 502 bp, Homo sapiens
  misc_feature: HIJSMM301DQGHL.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcagggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacg

SEQ ID NO: 582496 - DNA, 482 bp, Homo sapiens; identical to SEQ ID NO: 538815
  misc_feature: HIJSMM301BOPBD.4.34.D01.1.454.light.4.raw

SEQ ID NO: 582497 - DNA, 490 bp, Homo sapiens; identical to SEQ ID NO: 541407
  misc_feature: HIJSMM301D0ZHH.14.55.E11.1.454.light.4.raw

SEQ ID NO: 582498 - DNA, 491 bp, Homo sapiens
  misc_feature: HIJSMM301ASM2X.3.10.A10.1.454.light.4.raw
agacgcactccacgaccggtgctcgatttagcgtcgatctcagggggtgggtccaggaggcagaactctgggtgtctcaccatggcccggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccactgt

SEQ ID NO: 582499 - DNA, 489 bp, Homo sapiens
  misc_feature: HIJSMM301B1QFQ.49.58.F03.1.454.light.4.raw
agtcgagagacacgaccggtgctcgatttagtctgatcgagaagggaaaggggactgatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctacagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccgaaggtggagatcaaaacg

SEQ ID NO: 582500 - DNA, 465 bp, Homo sapiens; identical to SEQ ID NO: 538589
  misc_feature: HIJSMM301DI3O5.12.39.D06.1.454.light.4.raw

SEQ ID NO: 582501 - DNA, 486 bp, Homo sapiens; identical to SEQ ID NO: 536323
  misc_feature: HIJSMM301D3ZD7.10.2.A02.1.454.light.4.raw

SEQ ID NO: 582502 - DNA, 492 bp, Homo sapiens
  misc_feature: HIJSMM301EVWFA.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcatgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaa

SEQ ID NO: 582503 - DNA, 492 bp, Homo sapiens; identical to SEQ ID NO: 537509
  misc_feature: HIJSMM301AYIWG.13.46.E02.1.454.light.4.raw

SEQ ID NO: 582504 - DNA, 486 bp, Homo sapiens; identical to SEQ ID NO: 535043
  misc_feature: HIJSMM301DM2JT.46.35.D02.1.454.light.4.raw

SEQ ID NO: 582505 - DNA, 517 bp, Homo sapiens; identical to SEQ ID NO: 538938
  misc_feature: HIJSMM301DTJHZ.7.86.H09.1.454.light.4.raw

SEQ ID NO: 582506 - DNA, 504 bp, Homo sapiens; identical to SEQ ID NO: 555616
  misc_feature: HIJSMM301DBRUR.5.86.H09.1.454.light.4.raw

SEQ ID NO: 582507 - DNA, 468 bp, Homo sapiens; identical to SEQ ID NO: 555149
  misc_feature: HIJSMM301C2BEP.11.70.G04.1.454.light.4.raw

SEQ ID NO: 582508 - DNA, 496 bp, Homo sapiens
  misc_feature: HIJSMM301C44F3.26.12.B01.1.454.light.4.raw
agactatactcacgaccggtgctcgatttagtagtgtagattccgcggggagagctctggggaggaactgctcagtcaggacccagacggaaccatggaagccccagcgtcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccaagctggagatcaaccgaactgtggctgcaccatctgtt

SEQ ID NO: 582509 - DNA, 501 bp, Homo sapiens; identical to SEQ ID NO: 543782
  misc_feature: HIJSMM301EI625.10.9.A09.1.454.light.4.raw

SEQ ID NO: 582510 - DNA, 509 bp, Homo sapiens
  misc_feature: HIJSMM301AFGWI.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtaggatatacaaacgaactagtggctgcaccactctgt

SEQ ID NO: 582511 - DNA, 497 bp, Homo sapiens; identical to SEQ ID NO: 536371
  misc_feature: HIJSMM301CN9CV.16.78.H01.1.454.light.4.raw

SEQ ID NO: 582512 - DNA, 486 bp, Homo sapiens
  misc_feature: HIJSMM301DUACA.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccgaaggtggaactcaaacgaactgtggctgcaccatctgtcttcatcttcccgccactctgactagtctacg

SEQ ID NO: 582513 - DNA, 488 bp, Homo sapiens; identical to SEQ ID NO: 537329
  misc_feature: HIJSMM301B0IRY.26.23.C01.1.454.light.4.raw

SEQ ID NO: 582514 - DNA, 499 bp, Homo sapiens; identical to SEQ ID NO: 537739
  misc_feature: HIJSMM301BR0R9.12.86.H09.1.454.light.4.raw

SEQ ID NO: 582515 - DNA, 488 bp, Homo sapiens; identical to SEQ ID NO: 554127
  misc_feature: HIJSMM301CJGVS.10.77.G11.1.454.light.4.raw

SEQ ID NO: 582516 - DNA, 510 bp, Homo sapiens
  misc_feature: HIJSMM301DJG5B.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgtatactccgccgacgttcggccggggaccgaccgtggaaagtcaaacgaaactgtggctgcaccactctgtctt

SEQ ID NO: 582517 - DNA, 484 bp, Homo sapiens; identical to SEQ ID NO: 569020
  misc_feature: HIJSMM301CJ7WR.40.83.H06.1.454.light.4.raw

SEQ ID NO: 582518 - DNA, 479 bp, Homo sapiens
  misc_feature: HIJSMM301D4GGI.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtcgcccccttcaccctttcgggccaaaggggacacgactggagattagacg

SEQ ID NO: 582519 - DNA, 495 bp, Homo sapiens; identical to SEQ ID NO: 535596
  misc_feature: HIJSMM301BSMVH.10.79.H02.1.454.light.4.raw

SEQ ID NO: 582520 - DNA, 441 bp, Homo sapiens; identical to SEQ ID NO: 534971
  misc_feature: HIJSMM301ALZ3W.11.3.A03.1.454.light.4.raw

SEQ ID NO: 582521 - DNA, 513 bp, Homo sapiens
  misc_feature: HIJSMM301ESA3D.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactcttccg

SEQ ID NO: 582522 - DNA, 501 bp, Homo sapiens
  misc_feature: HIJSMM301B2RVR.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaaagctggagatcaaaacgaactgtggctgcaccatctgtcttcat

SEQ ID NO: 582523 - DNA, 503 bp, Homo sapiens; identical to SEQ ID NO: 543109
  misc_feature: HIJSMM301DGFG4.19.78.H01.1.454.light.4.raw

SEQ ID NO: 582524 - DNA, 493 bp, Homo sapiens
  misc_feature: HIJSMM301B3SC9.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggagggaccaaggtggagatcaaacgaactgtggctgcaccatctgtcttcatctcccgc

SEQ ID NO: 582525 - DNA, 496 bp, Homo sapiens
  misc_feature: HIJSMM301EL2F7.51.29.C07.1.454.light.4.raw
cgatcgtatacacgaccggtgctcgatttagagtgctacgaagggaaagggggaggaactgctcagtcaggacccagacggaaccatggaagccccagcgcagcttctcttcctcctgctactctggctcccagatactttactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaggactgtggctgcaccatctgtctt

SEQ ID NO: 582526 - DNA, 504 bp, Homo sapiens
  misc_feature: HIJSMM301DI31M.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtcctgggtcagcccaaggctgcccctcggt

SEQ ID NO: 582527 - DNA, 484 bp, Homo sapiens; identical to SEQ ID NO: 535211
  misc_feature: HIJSMM301AVB5Q.47.46.E02.1.454.light.4.raw

SEQ ID NO: 582528 - DNA, 486 bp, Homo sapiens; identical to SEQ ID NO: 535043
  misc_feature: HIJSMM301EY40U.46.35.D02.1.454.light.4.raw

SEQ ID NO: 582529 - DNA, 484 bp, Homo sapiens; identical to SEQ ID NO: 535240
  misc_feature: HIJSMM301DM37O.47.60.F05.1.454.light.4.raw

SEQ ID NO: 582530 - DNA, 501 bp, Homo sapiens
  misc_feature: HIJSMM301DEJ0G.13.11.A11.1.454.light.4.raw
tcacgtactacacgaccggtgctcgatttagctacgactgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttgacacaacaacgcctggatcttcggacctgggaccacggtcaccgtcctaggtcagcccaaggccaaccccactgtcactctgtt

SEQ ID NO: 582531 - DNA, 508 bp, Homo sapiens; identical to SEQ ID NO: 554548
  misc_feature: HIJSMM301DDT6T.17.87.H10.1.454.light.4.raw

SEQ ID NO: 582532 - DNA, 483 bp, Homo sapiens
  misc_feature: HIJSMM301AL9S7.52.77.G11.1.454.light.4.raw
cgcagtacgacacgaccggtgctcgatttagctagtcactcaagggaaagggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccaggcgagtcaggacattagcaactactttaaattggtatcagctgaaacccgggaaagcccctaagctcctgatcctcgatgcattcactttggaaacaggggtcccatcaaggttcagtgggagtggctctgggacagattttactttcaccatcagcagcctgcagcctgaggatattgcaacatattactgtcaacagtacgataatctcccgctcactttcggcgggggaccgaaggtggagatcaaacgaactgtggctgcacc

SEQ ID NO: 582533 - DNA, 489 bp, Homo sapiens; identical to SEQ ID NO: 543840
  misc_feature: HIJSMM301A2G10.12.88.H11.1.454.light.4.raw

SEQ ID NO: 582534 - DNA, 490 bp, Homo sapiens; identical to SEQ ID NO: 538714
  misc_feature: HIJSMM301A16EX.11.12.B01.1.454.light.4.raw

SEQ ID NO: 582535 - DNA, 521 bp, Homo sapiens
  misc_feature: HIJSMM301BS3NR.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccaccctcctcgagtacg

SEQ ID NO: 582536 - DNA, 488 bp, Homo sapiens
  misc_feature: HIJSMM301DSKU8.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgtgcagcgtgggatgacggtctgagtgctgtggtcttcggcggagggaccaagctgaccgtcctgggtcagcccaa

SEQ ID NO: 582537 - DNA, 508 bp, Homo sapiens; identical to SEQ ID NO: 536062
  misc_feature: HIJSMM301CLNP9.11.57.F02.1.454.light.4.raw

SEQ ID NO: 582538 - DNA, 488 bp, Homo sapiens; identical to SEQ ID NO: 544270
  misc_feature: HIJSMM301ALU13.48.29.C07.1.454.light.4.raw

SEQ ID NO: 582539 - DNA, 496 bp, Homo sapiens; identical to SEQ ID NO: 535541
  misc_feature: HIJSMM301EQ2VF.3.33.C11.1.454.light.4.raw

SEQ ID NO: 582540 - DNA, 505 bp, Homo sapiens; identical to SEQ ID NO: 536117
  misc_feature: HIJSMM301AFD8F.8.71.G05.1.454.light.4.raw

SEQ ID NO: 582541 - DNA, 444 bp, Homo sapiens; identical to SEQ ID NO: 535027
  misc_feature: HIJSMM301DMH7I.8.73.G07.1.454.light.4.raw

SEQ ID NO: 582542 - DNA, 507 bp, Homo sapiens
  misc_feature: HIJSMM301BIHE6.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgacccgtctctgggctccaggctgaggatgaggctgattattactgctactcatatgcaggcggcaactcttgggtgttcggcggagggaccaagctgaccgtcctaggtcagcccaaggctgccccctcggtccactctcg

SEQ ID NO: 582543 - DNA, 484 bp, Homo sapiens; identical to SEQ ID NO: 569020
  misc_feature: HIJSMM301DW648.40.83.H06.1.454.light.4.raw

SEQ ID NO: 582544 - DNA, 460 bp, Homo sapiens; identical to SEQ ID NO: 537107
  misc_feature: HIJSMM301DHYU5.22.28.C06.1.454.light.4.raw

SEQ ID NO: 582545 - DNA, 505 bp, Homo sapiens
  misc_feature: HIJSMM301CUNIO.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccccactgtcta

SEQ ID NO: 582546 - DNA, 496 bp, Homo sapiens; identical to SEQ ID NO: 535109
  misc_feature: HIJSMM301BHDVI.16.78.H01.1.454.light.4.raw

SEQ ID NO: 582547 - DNA, 502 bp, Homo sapiens; identical to SEQ ID NO: 536253
  misc_feature: HIJSMM301EIAIJ.21.22.B11.1.454.light.4.raw

SEQ ID NO: 582548 - DNA, 480 bp, Homo sapiens; identical to SEQ ID NO: 535442
  misc_feature: HIJSMM301A140V.41.17.B06.1.454.light.4.raw

SEQ ID NO: 582549 - DNA, 383 bp, Homo sapiens; identical to SEQ ID NO: 447524
  misc_feature: HIJSMM301EXTVY.41.26.C04.1.454.light.4.raw

SEQ ID NO: 582550 - DNA, 494 bp, Homo sapiens
  misc_feature: HIJSMM301DOFOZ.43.55.E11.1.454.light.4.raw
tgtgagtagtcacgaccggtgctcgatttagcactcgcacgttgggtttggagggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagccaaggccaa

SEQ ID NO: 582551 - DNA, 480 bp, Homo sapiens
  misc_feature: HIJSMM301BAZ8G.48.53.E09.1.454.light.4.raw
agtatacatacacgaccggtgctcgatttagagagagtgtgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcacataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagcccaac

SEQ ID NO: 582552 - DNA, 505 bp, Homo sapiens
  misc_feature: HIJSMM301CE8EW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaaggtggaaatcaaacgaactagtggctgcaccatctgtcttcatcttccccg

SEQ ID NO: 582553 - DNA, 482 bp, Homo sapiens
  misc_feature: HIJSMM301BSZH5.4.39.D06.1.454.light.4.raw
agcactgtagcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggtcgttcggccaggggaccaaggtcgaaatgagacgaactgtggctgcaccatctgtt

SEQ ID NO: 582554 - DNA, 522 bp, Homo sapiens
  misc_feature: HIJSMM301BA0M6.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccaggggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtggggcaggtcagcccaacggccaacccactgtcactcttccg

SEQ ID NO: 582555 - DNA, 497 bp, Homo sapiens; identical to SEQ ID NO: 540789
  misc_feature: HIJSMM301CGRHB.9.67.G01.1.454.light.4.raw

SEQ ID NO: 582556 - DNA, 502 bp, Homo sapiens
  misc_feature: HIJSMM301BGZ7V.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaatagaggtcaaacgaactagtggctgcaccatctgtcttcat

SEQ ID NO: 582557 - DNA, 504 bp, Homo sapiens; identical to SEQ ID NO: 540538
  misc_feature: HIJSMM301C6PAJ.7.71.G05.1.454.light.4.raw

SEQ ID NO: 582558 - DNA, 492 bp, Homo sapiens
  misc_feature: HIJSMM301AE7RR.52.54.E10.1.454.light.4.raw
cgcagtacgacacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccca

SEQ ID NO: 582559 - DNA, 515 bp, Homo sapiens
  misc_feature: HIJSMM301CUKTN.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggcaaggaccaaggtggcaatcaacgaactgtggctgcaccatctgtcttcatccttcccg

SEQ ID NO: 582560 - DNA, 518 bp, Homo sapiens; identical to SEQ ID NO: 539372
  misc_feature: HIJSMM301DYCIN.7.86.H09.1.454.light.4.raw

SEQ ID NO: 582561 - DNA, 518 bp, Homo sapiens; identical to SEQ ID NO: 539372
  misc_feature: HIJSMM301C5DOJ.7.86.H09.1.454.light.4.raw

SEQ ID NO: 582562 - DNA, 489 bp, Homo sapiens; identical to SEQ ID NO: 544819
  misc_feature: HIJSMM301ESQDQ.11.28.C06.1.454.light.4.raw

SEQ ID NO: 582563 - DNA, 492 bp, Homo sapiens; identical to SEQ ID NO: 541650
  misc_feature: HIJSMM301DL6TQ.5.57.F02.1.454.light.4.raw

SEQ ID NO: 582564 - DNA, 454 bp, Homo sapiens; identical to SEQ ID NO: 534964
  misc_feature: HIJSMM301B0KGN.19.86.H09.1.454.light.4.raw

SEQ ID NO: 582565 - DNA, 494 bp, Homo sapiens; identical to SEQ ID NO: 534994
  misc_feature: HIJSMM301A8691.27.78.H01.1.454.light.4.raw

SEQ ID NO: 582566 - DNA, 469 bp, Homo sapiens
  misc_feature: HIJSMM301BXDOM.40.1.A01.1.454.light.4.raw
tctagcgactcacgaccggtgctcgatttagacgtctcatcagggggagtcagtcccaaccaggacacagcatggacatgagggtccctgctcagctcctggggctcctgctgctctggctctcaggtgccagatgtgacatccagctgacccagtctccatcctccctgtctgcatctgttggagacagagtcaccatcacttgccaggcgagtcaggacattagtaaatatttgaattggtatcaacaaaaccagggaaagcccctaagctcctgatctacgatgcatctaagttggaacaggggtctcatcaaggttcagtggaagtggatctgggacagatcctactttcaccatcagcagcctgcagccagaagatattgcgacatattctgtcaggtgtatgaaagtctccctgttttggtccaggggaccaagatggagatcaaacgaactgtggctgcacc

SEQ ID NO: 582567 - DNA, 508 bp, Homo sapiens
  misc_feature: HIJSMM301BOI5P.40.16.B05.1.454.light.4.raw
  modified_base (442)..(442): a, c, t, g, unknown or other
tctagcgactcacgaccggtgctcgatttagagctcacgtaagggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgaccatctctgggctccaggctgaggatgaggctgattattactgctgctcatttgcaggtagttttgggtgttcggnggaccccgggacaagctgaccgtcctaggtcagcccaaggctgccccctcggtcactctgttcccg

SEQ ID NO: 582568 - DNA, 514 bp, Homo sapiens; identical to SEQ ID NO: 541418
  misc_feature: HIJSMM301CUMNC.17.33.C11.1.454.light.4.raw

SEQ ID NO: 582569 - DNA, 502 bp, Homo sapiens; identical to SEQ ID NO: 573431
  misc_feature: HIJSMM301EQBK2.5.60.F05.1.454.light.4.raw

SEQ ID NO: 582570 - DNA, 501 bp, Homo sapiens
  misc_feature: HIJSMM301EC60U.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattattctgcggctcatatggagacaattacagctttgtcttcggaagtgggaccaaggtcaccgtcctaagtcagcccaaggccaacccactgcactctgttcccacct

SEQ ID NO: 582571 - DNA, 467 bp, Homo sapiens
  misc_feature: HIJSMM301A7JUI.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccactttgcaaagtgggtcccatcaaggttcagtggcagtggatctgggacagatttcactctaaccatcagcggtctgcaacctgaagattttgcaactcaactactgtcaacagagtgacagcacgcctcacacttcggcggagggaccgaaggtggagatacaaacgaa

SEQ ID NO: 582572 - DNA, 501 bp, Homo sapiens; identical to SEQ ID NO: 535873
  misc_feature: HIJSMM301AVC5W.17.27.C05.1.454.light.4.raw

SEQ ID NO: 582573 - DNA, 474 bp, Homo sapiens; identical to SEQ ID NO: 552964
  misc_feature: HIJSMM301BG6O8.15.81.H04.1.454.light.4.raw

SEQ ID NO: 582574 - DNA, 444 bp, Homo sapiens
  misc_feature: HIJSMM301ERJLI.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcataagtcagcccaaggctgccccctcggtcactctgttcccgccctcctctgtcgagcgt

SEQ ID NO: 582575 - DNA, 502 bp, Homo sapiens
  misc_feature: HIJSMM301AOXIS.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgtcccaccctcc

SEQ ID NO: 582576 - DNA, 499 bp, Homo sapiens
  misc_feature: HIJSMM301C4R2A.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaattattatattcctcctcagacgttcggccaagggaccaaggtggaaatcaaacgaactgtggctgcacc

SEQ ID NO: 582577 - DNA, 506 bp, Homo sapiens; identical to SEQ ID NO: 542696
  misc_feature: HIJSMM301DPK5V.7.71.G05.1.454.light.4.raw

SEQ ID NO: 582578 - DNA, 511 bp, Homo sapiens
  misc_feature: HIJSMM301D23ET.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcgggcggggggaccaaggctgaccgtcctaggtcagcccaaggctcgtccccccg

SEQ ID NO: 582579 - DNA, 509 bp, Homo sapiens
  misc_feature: HIJSMM301BZSYV.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggtcggagggaccgaaggtggagatcaaacgaactgtggctggcaccatctgtt

SEQ ID NO: 582580 - DNA, 497 bp, Homo sapiens; identical to SEQ ID NO: 539718
  misc_feature: HIJSMM301C8DAX.40.54.E10.1.454.light.4.raw

SEQ ID NO: 582581 - DNA, 481 bp, Homo sapiens
  misc_feature: HIJSMM301BBQ4L.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtaggagatacaaacgaaactgtggctgcac

SEQ ID NO: 582582 - DNA, 501 bp, Homo sapiens; identical to SEQ ID NO: 535746
  misc_feature: HIJSMM301DGOWU.18.11.A11.1.454.light.4.raw

SEQ ID NO: 582583 - DNA, 488 bp, Homo sapiens
  misc_feature: HIJSMM301DXZE6.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcgaccaagggaccaaggtagaaatcaaacgaactgtggctgcaccatctgtt

SEQ ID NO: 582584 - DNA, 498 bp, Homo sapiens; identical to SEQ ID NO: 544837
  misc_feature: HIJSMM301ELBK6.11.71.G05.1.454.light.4.raw

SEQ ID NO: 582585 - DNA, 484 bp, Homo sapiens; identical to SEQ ID NO: 566663
  misc_feature: HIJSMM301AT04E.49.55.E11.1.454.light.4.raw

SEQ ID NO: 582586 - DNA, 527 bp, Homo sapiens
  misc_feature: HIJSMM301COK3G.40.27.C05.1.454.light.4.raw
  modified_base (451)..(451): a, c, t, g, unknown or other
  modified_base (462)..(463): a, c, t, g, unknown or other
  modified_base (477)..(477): a, c, t, g, unknown or other
  modified_base (504)..(504): a, c, t, g, unknown or other
tctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggccccgaggatgaggcggattattattgtgtgtcatgggagtgacagaatgaatggtccggtgttgcggngggaccgagtnnacgtcctagtcganccacgactgcccctccggtccactctnttcctaccctcctccagtcgtcg

SEQ ID NO: 582587 - DNA, 489 bp, Homo sapiens; identical to SEQ ID NO: 544582
  misc_feature: HIJSMM301DM6NM.22.65.F10.1.454.light.4.raw

SEQ ID NO: 582588 - DNA, 496 bp, Homo sapiens
  misc_feature: HIJSMM301EH6X6.9.27.C05.1.454.light.4.raw
tgatacgtctcacgaccggtgctcgatttagacgcgatcgaagggtttgggggaggaactgctcagttaggacccagacggaaccatggaagccccagcgcagcttctcttcctcctgctactctggctcccagatatcaatggagaaatagtaatgacgcagtctccagccgtcctgtctgtgtctccaggggaaagagccaccctctcctgtcgggccagtcagagtgttagaagcaacttagcctggtaccaacagagacctggccagcctcccaggctcctcatctttgatgcatccactagggccagtggaatcccagacaggttcagtggcagtgggtctgggacagagttcactctcagcatcaacagcgtgcgggctgaagattttgtttttattattgtcagcagtatgataactggcctctgtggacgttcggccaagggaccaaggtgatgtcaaacgaactgtggctgcaccatctgtcttcat

SEQ ID NO: 582589 - DNA, 505 bp, Homo sapiens
  misc_feature: HIJSMM301EDPJ7.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctggtcact

SEQ ID NO: 582590 - DNA, 488 bp, Homo sapiens
  misc_feature: HIJSMM301DU9F4.17.25.C03.1.454.light.4.raw
cgtagactagcacgaccggtgctcgatttagtagtgtagatttgggtttgggagtcagtctcagtcaggacacagcatggacatgagggtccccgctcagctcctggggctcctgctactctggctccgagctgccagatgtgacatccagatgacccagtctccatcctccctgtctgcctctgtgggggtcagagtcaccatcacttgccggacaagtcacggcgttaaaaacctatttaaattggtatcagcagaaacctggaaaagccccagacctcctgatctctggtgcatccactctgcgaagtggcgtcccatcgaggttcagtggcagtggatctgggacagatttcaatctcaccatcaccactctgcaacctgaggattgtgcaatctactactgtcaacagagttacagttcccctcgcacttttggccaggggaccaaagttgagatcaaacgaactgtggctgcaccatctgtt

SEQ ID NO: 582591 - DNA, 465 bp, Homo sapiens
  misc_feature: HIJSMM301A0SGU.17.28.C06.1.454.light.4.raw
cgtagactagcacgaccggtgctcgatttagagctcacgtattgggtttggagggtgtggtggtctccactcccgcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatgggtccggtgttcggcggagggaccaggctgaccgtcctaagtcagccaaggctgccccctcggtcactctcgttcccgccctcctcctagtctacg

SEQ ID NO: 582592 - DNA, 495 bp, Homo sapiens
  misc_feature: HIJSMM301DSYC3.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgttcttcggaactgcgaccaaggtcaccgtctgggtcagcccaaggccaacccactgtcact

SEQ ID NO: 582593 - DNA, 527 bp, Homo sapiens
  misc_feature: HIJSMM301BT9VJ.9.25.C03.1.454.light.4.raw
tgatacgtctcacgaccggtgctcgatttagtagtgtagatttgggtttgggggtgagggttgagaacctatgaacattctgtaggggccaccgttctcctcctcggcctcctctctcactgcacagtctttgtagactctgtgaccttccatgtgctgactcagccaccctcggtgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgccccctcggtcactctgttcccaccctcctcagtacg

SEQ ID NO: 582594 - DNA, 501 bp, Homo sapiens
  misc_feature: HIJSMM301AF5PN.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctc

SEQ ID NO: 582595 - DNA, 488 bp, Homo sapiens; identical to SEQ ID NO: 536710
  misc_feature: HIJSMM301AFL1X.21.55.E11.1.454.light.4.raw

SEQ ID NO: 582596 - DNA, 494 bp, Homo sapiens; identical to SEQ ID NO: 534994
  misc_feature: HIJSMM301D76V0.27.78.H01.1.454.light.4.raw

SEQ ID NO: 582597 - DNA, 487 bp, Homo sapiens; identical to SEQ ID NO: 560173
  misc_feature: HIJSMM301CFFLZ.47.70.G04.1.454.light.4.raw

SEQ ID NO: 582598 - DNA, 496 bp, Homo sapiens; identical to SEQ ID NO: 539888
  misc_feature: HIJSMM301DYBFY.15.58.F03.1.454.light.4.raw

SEQ ID NO: 582599 - DNA, 503 bp, Homo sapiens
  misc_feature: HIJSMM301DKY1Q.49.43.D10.1.454.light.4.raw
agtcgagagacacgaccggtgctcgatttagactagcagtaaggggagagaagacaggactcaggacaatctccagcatggccagcttccctctcctcctcaccctcctcactcactgtgcagggtcctgggcccagtctgtgctgactcagccaccctcagcgtctgggactcccgggcagagggtcaccatctcttgttctggaggcagctccaacatcggaagtaatgatgttaactggtaccaacaaattccagggacggcccccaatgtcttcatctttggtaatgatcagcggccctcaggggtccctgaccgattctctggctccaagtctggcacctcagcctccctggccatcagtgggctccagtctgaggatgaggctgattattactgtgcaacatgggatgacagcctgaatgccgtggttttcggcggagggaccaaggtgaccgtcctaggtcagcccaaggctgccccctcggtcactctgttcccg

SEQ ID NO: 582600 - DNA, 507 bp, Homo sapiens; identical to SEQ ID NO: 564208
  misc_feature: HIJSMM301CC0CA.5.24.C02.1.454.light.4.raw

SEQ ID NO: 582601 - DNA, 506 bp, Homo sapiens
  misc_feature: HIJSMM301BQ43N.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacttcggccctcgggaccaaagtggatatcaaacgaactgtggctgcaccatctgtctt

SEQ ID NO: 582602 - DNA, 491 bp, Homo sapiens
  misc_feature: HIJSMM301AMKV0.14.36.D03.1.454.light.4.raw
cgtctagtaccacgaccggtgctcgatttagctgcgtcacgatctctcttgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatggtggttttcggcggggggaccaaggtgaccgtcctaggtcagccc

SEQ ID NO: 582603 - DNA, 496 bp, Homo sapiens; identical to SEQ ID NO: 537925
  misc_feature: HIJSMM301CPXU6.22.14.B03.1.454.light.4.raw

SEQ ID NO: 582604 - DNA, 486 bp, Homo sapiens; identical to SEQ ID NO: 535043
  misc_feature: HIJSMM301EAOZ2.46.35.D02.1.454.light.4.raw

SEQ ID NO: 582605 - DNA, 486 bp, Homo sapiens; identical to SEQ ID NO: 535043
  misc_feature: HIJSMM301BALRN.46.35.D02.1.454.light.4.raw

SEQ ID NO: 582606 - DNA, 483 bp, Homo sapiens
  misc_feature: HIJSMM301DO4FP.49.27.C05.1.454.light.4.raw
agtcgagagacacgaccggtgctcgatttagacgcgatcgaagggtttggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaacgaa

SEQ ID NO: 582607 - DNA, 489 bp, Homo sapiens; identical to SEQ ID NO: 535139
  misc_feature: HIJSMM301ATRFN.14.55.E11.1.454.light.4.raw

SEQ ID NO: 582608 - DNA, 524 bp, Homo sapiens
  misc_feature: HIJSMM301BF4U7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccgaacgggaccgaagggtaggaaaagtacgaaaacgaaccgtaggtggcgtggcaccaatctgtcttcacttcttcccccg

SEQ ID NO: 582609 - DNA, 499 bp, Homo sapiens
  misc_feature: HIJSMM301EP4AC.10.79.H02.1.454.light.4.raw
  modified_base (489)..(489): a, c, t, g, unknown or other
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacgttttgccacgggaccgaagctggagatacaaacgaaactagtggctgcaccanctgtcttcta

SEQ ID NO: 582610 - DNA, 500 bp, Homo sapiens
  misc_feature: HIJSMM301DGEZH.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgtcgtccgacggacgaacggtaggaacgtactaacgaaactagtggct

SEQ ID NO: 582611 - DNA, 512 bp, Homo sapiens
  misc_feature: HIJSMM301CW1QW.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttggtgttcggcggagggaccaagttgaccgtcctaggtcagcccaaggctgccccctcggtcactctgttccccg

SEQ ID NO: 582612 - DNA, 491 bp, Homo sapiens
  misc_feature: HIJSMM301C3WJE.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaacgggaccgaaggtaggaaatacaaacgaaacctgttggctgcaccta

SEQ ID NO: 582613 - DNA, 499 bp, Homo sapiens; identical to SEQ ID NO: 550492
  misc_feature: HIJSMM301D8SP2.43.66.F11.1.454.light.4.raw

SEQ ID NO: 582614 - DNA, 498 bp, Homo sapiens
  misc_feature: HIJSMM301DU3ZZ.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgaagtgttcggcggagggaccgagctggaccgtcctacgtcagcccaaggctcg

SEQ ID NO: 582615 - DNA, 494 bp, Homo sapiens; identical to SEQ ID NO: 534994
  misc_feature: HIJSMM301CN6SW.27.78.H01.1.454.light.4.raw

SEQ ID NO: 582616 - DNA, 504 bp, Homo sapiens; identical to SEQ ID NO: 535935
  misc_feature: HIJSMM301CWN4F.18.78.H01.1.454.light.4.raw

SEQ ID NO: 582617 - DNA, 503 bp, Homo sapiens
  misc_feature: HIJSMM301ARLNX.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcattatgccggtgatagtggccgaagggtgttcggcggagggaccaaggtgaccgtctaggtcagcccaaggctgccccctcggt

SEQ ID NO: 582618 - DNA, 512 bp, Homo sapiens; identical to SEQ ID NO: 548157
  misc_feature: HIJSMM301A5IWE.17.33.C11.1.454.light.4.raw

SEQ ID NO: 582619 - DNA, 507 bp, Homo sapiens; identical to SEQ ID NO: 544755
  misc_feature: HIJSMM301BYV98.11.57.F02.1.454.light.4.raw

SEQ ID NO: 582620 - DNA, 490 bp, Homo sapiens; identical to SEQ ID NO: 543909
  misc_feature: HIJSMM301ALP5X.14.55.E11.1.454.light.4.raw

SEQ ID NO: 582621 - DNA, 485 bp, Homo sapiens; identical to SEQ ID NO: 538954
  misc_feature: HIJSMM301DKHBV.3.55.E11.1.454.light.4.raw

SEQ ID NO: 582622 - DNA, 499 bp, Homo sapiens
  misc_feature: HIJSMM301EIFOY.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaaccca

SEQ ID NO: 582623 - DNA, 498 bp, Homo sapiens
  misc_feature: HIJSMM301D3EDI.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttatactgtcagcagtataattactggcctcggacgttcggccgaacgggaccgaacggtggaagtacgaaacgaactagtggcgtgcaccatctgtctt

SEQ ID NO: 582624 - DNA, 507 bp, Homo sapiens; identical to SEQ ID NO: 559118
  misc_feature: HIJSMM301C6Z9D.17.87.H10.1.454.light.4.raw

SEQ ID NO: 582625 - DNA, 494 bp, Homo sapiens
  misc_feature: HIJSMM301D2XA7.11.81.H04.1.454.light.4.raw
cgagagataccacgaccggtgctcgatttagtagtgtagattcgcgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtatgggacagagttcactctcaccatcagcagcctgcagtctgaagattttgcagtttttactgtcagcagtatagtaactggcctccgtacacttttggccaggggaccaagctagaaatcaaacgaactgtggctgcaccatctgtcttcta

SEQ ID NO: 582626 - DNA, 505 bp, Homo sapiens
  misc_feature: HIJSMM301AW8JM.21.22.B11.1.454.light.4.raw
  modified_base (429)..(429): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacncaacatggggatggacaatctggagcggttgggtgttcggcggagggaccaaactgaccgtcctaggtcagcccaa

SEQ ID NO: 582627 - DNA, 490 bp, Homo sapiens
  misc_feature: HIJSMM301EG93Y.43.34.D01.1.454.light.4.raw
tgtgagtagtcacgaccggtgctcgatttagatcgtctgtgttgggtttgggtggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgcagctcatatacaagcagcagcacttatgtcttcggaactgggaccaaggtcaccgacctaggtcagcccaac

SEQ ID NO: 582628 - DNA, 493 bp, Homo sapiens; identical to SEQ ID NO: 535084
  misc_feature: HIJSMM301AQI8A.47.64.F09.1.454.light.4.raw

SEQ ID NO: 582629 - DNA, 489 bp, Homo sapiens; identical to SEQ ID NO: 535139
  misc_feature: HIJSMM301CJJGK.14.55.E11.1.454.light.4.raw

SEQ ID NO: 582630 - DNA, 489 bp, Homo sapiens; identical to SEQ ID NO: 535091
  misc_feature: HIJSMM301DSZTR.47.36.D03.1.454.light.4.raw

SEQ ID NO: 582631 - DNA, 484 bp, Homo sapiens; identical to SEQ ID NO: 536393
  misc_feature: HIJSMM301BBGR5.4.41.D08.1.454.light.4.raw

SEQ ID NO: 582632 - DNA, 486 bp, Homo sapiens
  misc_feature: HIJSMM301E0YTY.49.57.F02.1.454.light.4.raw
agtcgagagacacgaccggtgctcgatttagctcgatatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggaggatcaaaacg

SEQ ID NO: 582633 - DNA, 515 bp, Homo sapiens; identical to SEQ ID NO: 541016
  misc_feature: HIJSMM301DQLYE.43.23.C01.1.454.light.4.raw

SEQ ID NO: 582634 - DNA, 479 bp, Homo sapiens; identical to SEQ ID NO: 535118
  misc_feature: HIJSMM301AU8HG.13.59.F04.1.454.light.4.raw

SEQ ID NO: 582635 - DNA, 519 bp, Homo sapiens
  misc_feature: HIJSMM301EXSXL.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggttccgaagccggggatgaggccgactattactgtcaggtgtgggatagtgatacggaccattgggtgttcggcggagggaccaaggtgaccgtcctaggtcagcccaaggctgcccctcggtcactctgttcccaccctcctctctctcg

SEQ ID NO: 582636 - DNA, 496 bp, Homo sapiens
  misc_feature: HIJSMM301COWVJ.13.10.A10.1.454.light.4.raw
tcacgtactacacgaccggtgctcgatttagcgtcgatctcagggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacggggcccaggcagaagatgaatctgattattactgtgttctttatatgggtagtgccatttctgctgtgttcggaggaggcacccggctgaccgtcctcggtcagcccaaggctgcccc

SEQ ID NO: 582637 - DNA, 500 bp, Homo sapiens; identical to SEQ ID NO: 539012
  misc_feature: HIJSMM301B0098.48.36.D03.1.454.light.4.raw

SEQ ID NO: 582638 - DNA, 485 bp, Homo sapiens; identical to SEQ ID NO: 535985
  misc_feature: HIJSMM301AFKY1.15.1.A01.1.454.light.4.raw

SEQ ID NO: 582639 - DNA, 491 bp, Homo sapiens; identical to SEQ ID NO: 536211
  misc_feature: HIJSMM301DBB7H.16.53.E09.1.454.light.4.raw

SEQ ID NO: 582640 - DNA, 444 bp, Homo sapiens; identical to SEQ ID NO: 535192
  misc_feature: HIJSMM301E0OZC.5.9.A09.1.454.light.4.raw

SEQ ID NO: 582641 - DNA, 502 bp, Homo sapiens; identical to SEQ ID NO: 552020
  misc_feature: HIJSMM301BP6KP.49.82.H05.1.454.light.4.raw

SEQ ID NO: 582642 - DNA, 508 bp, Homo sapiens; identical to SEQ ID NO: 563558
  misc_feature: HIJSMM301A1ML5.47.85.H08.1.454.light.4.raw

SEQ ID NO: 582643 - DNA, 492 bp, Homo sapiens; identical to SEQ ID NO: 540273
  misc_feature: HIJSMM301CCKNA.16.53.E09.1.454.light.4.raw

SEQ ID NO: 582644 - DNA, 485 bp, Homo sapiens
  misc_feature: HIJSMM301DX7VO.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgctcggccaagggaccaaggtagaaatacaaacgaactgtggctgacaccat

SEQ ID NO: 582645 - DNA, 494 bp, Homo sapiens; identical to SEQ ID NO: 534994
  misc_feature: HIJSMM301EI4VJ.27.78.H01.1.454.light.4.raw

SEQ ID NO: 582646 - DNA, 443 bp, Homo sapiens
  misc_feature: HIJSMM301DG48H.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccgccctcctcagcgtatca

SEQ ID NO: 582647 - DNA, 499 bp, Homo sapiens
  misc_feature: HIJSMM301D11LT.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaaatcaaaacgaactgtggctgcacc

SEQ ID NO: 582648 - DNA, 493 bp, Homo sapiens
  misc_feature: HIJSMM301EBLZH.15.3.A03.1.454.light.4.raw
  modified_base (396)..(396): a, c, t, g, unknown or other
  modified_base (434)..(434): a, c, t, g, unknown or other
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagntgtggctagtttattactgtcagcaatatagaaagttnttccttttactttcggccctgggaccaaagtggatatcaaacaactgtggctgcaccat

SEQ ID NO: 582649 - DNA, 521 bp, Homo sapiens; identical to SEQ ID NO: 538715
  misc_feature: HIJSMM301BK6UQ.27.23.C01.1.454.light.4.raw

SEQ ID NO: 582650 - DNA, 489 bp, Homo sapiens
  misc_feature: HIJSMM301B23AL.41.23.C01.1.454.light.4.raw
tctatactatcacgaccggtgctcgatttagtacacgtgattagggattggggggggagcctagctgtgctgtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagggaccgaagctgaccgtccttc

SEQ ID NO: 582651 - DNA, 490 bp, Homo sapiens; identical to SEQ ID NO: 536855
  misc_feature: HIJSMM301CIGFL.16.68.G02.1.454.light.4.raw

SEQ ID NO: 582652 - DNA, 494 bp, Homo sapiens; identical to SEQ ID NO: 540767
  misc_feature: HIJSMM301A9K5V.11.81.H04.1.454.light.4.raw

SEQ ID NO: 582653 - DNA, 493 bp, Homo sapiens
  misc_feature: HIJSMM301DOZJ4.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgactgtggctgcaccatct

SEQ ID NO: 582654 - DNA, 497 bp, Homo sapiens
  misc_feature: HIJSMM301DEXB5.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctataggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtctacgtcagcccaaggctgccccctcggtcactctcg

SEQ ID NO: 582655 - DNA, 487 bp, Homo sapiens; identical to SEQ ID NO: 535583
  misc_feature: HIJSMM301DM2UF.22.73.G07.1.454.light.4.raw

SEQ ID NO: 582656 - DNA, 485 bp, Homo sapiens; identical to SEQ ID NO: 536263
  misc_feature: HIJSMM301CRAMU.47.78.H01.1.454.light.4.raw

SEQ ID NO: 582657 - DNA, 489 bp, Homo sapiens; identical to SEQ ID NO: 535691
  misc_feature: HIJSMM301AUHL6.12.31.C09.1.454.light.4.raw

SEQ ID NO: 582658 - DNA, 484 bp, Homo sapiens; identical to SEQ ID NO: 535441
  misc_feature: HIJSMM301DCBVK.26.60.F05.1.454.light.4.raw

SEQ ID NO: 582659 - DNA, 502 bp, Homo sapiens
  misc_feature: HIJSMM301C1PAE.9.53.E09.1.454.light.4.raw
tgatacgtctcacgaccggtgctcgatttagagagagtgtgttgggtttgggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccgccctcctcagacgtatca

SEQ ID NO: 582660 - DNA, 447 bp, Homo sapiens; identical to SEQ ID NO: 535020
  misc_feature: HIJSMM301A68BC.18.9.A09.1.454.light.4.raw

SEQ ID NO: 582661 - DNA, 473 bp, Homo sapiens; identical to SEQ ID NO: 546980
  misc_feature: HIJSMM301EGYU8.15.8.A08.1.454.light.4.raw

SEQ ID NO: 582662 - DNA, 513 bp, Homo sapiens
  misc_feature: HIJSMM301C8PZ0.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcattctgtt

SEQ ID NO: 582663 - DNA, 489 bp, Homo sapiens; identical to SEQ ID NO: 536013
  misc_feature: HIJSMM301DR0UK.26.23.C01.1.454.light.4.raw

SEQ ID NO: 582664 - DNA, 492 bp, Homo sapiens
  misc_feature: HIJSMM301AFOGY.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactacctctcactttcggaggagggaccagggtggagatcaaacgaactgtggctgcaccatctgtcttcta

SEQ ID NO: 582665 - DNA, 481 bp, Homo sapiens; identical to SEQ ID NO: 535993
  misc_feature: HIJSMM301BPLI7.21.25.C03.1.454.light.4.raw

SEQ ID NO: 582666 - DNA, 491 bp, Homo sapiens
  misc_feature: HIJSMM301AWWHN.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcacccttcggccaagggacacgactggagattaaacgaactgtggctgcaccatctgtcttcat

SEQ ID NO: 582667 - DNA, 484 bp, Homo sapiens
  misc_feature: HIJSMM301ELJX0.43.24.C02.1.454.light.4.raw
tgtgagtagtcacgaccggtgctcgatttagtacagatcgttagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaattcgggcctccggggtccctgacaggttcagtggcagtggatcaggcacagattttacactgaaaatcagcagagtggaggctgaggatgttggggtttattactgcatgcaagctctacaaactccgctcactttcggcggagggaccaaggtggagatcaaacgaa

SEQ ID NO: 582668 - DNA, 508 bp, Homo sapiens; identical to SEQ ID NO: 537871
  misc_feature: HIJSMM301DR3KF.8.33.C11.1.454.light.4.raw

SEQ ID NO: 582669 - DNA, 490 bp, Homo sapiens
  misc_feature: HIJSMM301AUS7E.4.52.E08.1.454.light.4.raw
  modified_base (213)..(213): a, c, t, g, unknown or other
agcactgtagcacgaccggtgctcgatttagtcgagctctcaggagagaaaggggcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaanagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccaaggtggagatcaaacgaact

SEQ ID NO: 582670 - DNA, 521 bp, Homo sapiens; identical to SEQ ID NO: 578135
  misc_feature: HIJSMM301B9BJ9.9.38.D05.1.454.light.4.raw

SEQ ID NO: 582671 - DNA, 495 bp, Homo sapiens
  misc_feature: HIJSMM301EQNJI.53.1.A01.1.454.light.4.raw
cgcgtatacacacgaccggtgctcgatttagacgtctcatcaaggaagggaagggggtgggtccaggaggcagaactctgggtgtctcaccatggcctggatccctctacttctccccctcctcactctctgcacaggctctgaggcctcctatgagctgacacagtcaccctcggtgtctgtgtcctcaggacagacggccaggatcacctgctctggcgatgcattgccaaaacaatatgcttactggtaccagcagaggccaggccaggcccctgtcttggtgatttataaagactttgagaggccctcagggacccctgagcgattctctggctccagctcagggacaacagtcaccttgaccatcagtggagtccggccagaggacgaggctgactattactgtcagtccgcagacagcagtggcagttatgtcgtattcggcggagggactacgctgaccgtcctaggtcagcccaaggctgccccctc

SEQ ID NO: 582672 - DNA, 490 bp, Homo sapiens
  misc_feature: HIJSMM301ECD7Z.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagtatttgcagtctattactgtcagcagtatggtcacgtcccaagtaacttttggaccaggggaccaagctggagatacaaacgaactgtggctggcaccat

SEQ ID NO: 582673 - DNA, 476 bp, Homo sapiens
  misc_feature: HIJSMM301DTCUA.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactaactgtcaacagagttccactaccccaatcactttcggccctggactgaagtgcatatgaagagaactgtggctgca

SEQ ID NO: 582674 - DNA, 504 bp, Homo sapiens
  misc_feature: HIJSMM301CKKJ1.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgccttcccagtccttctcaggggtcccctcgaggttcagtggcaggtggatctgggacacatttcaccctcaccatcaatagcctggaagctgaagatgctgcaacttattactgtcatcagagtactactttacctcaagtgatcaccttcggcaacggacacgactggagattaaacg

SEQ ID NO: 582675 - DNA, 501 bp, Homo sapiens
  misc_feature: HIJSMM301CAZP2.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctccttatctatggtgcatccaccagggccactggtatcccagccaggttcagtggcagtgggtctgggacagagttcactctcaccatcagcagcctgcagtctgaagattttgcggtttattactgtctagcagtataataactggcctccacggtacacttttggcctaggggaccaagctggagatacaacgaactgtggctgcaccatctgtctt

SEQ ID NO: 582676 - DNA, 512 bp, Homo sapiens; identical to SEQ ID NO: 537564
  misc_feature: HIJSMM301ASDOU.17.33.C11.1.454.light.4.raw

SEQ ID NO: 582677 - DNA, 485 bp, Homo sapiens; identical to SEQ ID NO: 543180
  misc_feature: HIJSMM301DA1CZ.3.10.A10.1.454.light.4.raw

SEQ ID NO: 582678 - DNA, 509 bp, Homo sapiens
  misc_feature: HIJSMM301B1GDH.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatggacggtctgagtgctgtggtcttcggcggagggaccaagctgaccgtcctgggtcagcccaaggctcgccccctcggtcacttc

SEQ ID NO: 582679 - DNA, 484 bp, Homo sapiens
  misc_feature: HIJSMM301CAILU.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcttccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 582680 - DNA, 504 bp, Homo sapiens
  misc_feature: HIJSMM301A7XSB.18.78.H01.1.454.light.4.raw
tacgagtatgcacgaccggtgctcgatttagtgtgagtagtttgggtttggggggggtctcaggaggcagtgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctaggtcagcccaaggccaacccactgtca

SEQ ID NO: 582681 - DNA, 509 bp, Homo sapiens
  misc_feature: HIJSMM301BWHEH.5.24.C02.1.454.light.4.raw
atcagacacgcacgaccggtgctcgatttagtacagatcgttagggaaagggggggtcgtcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaacctcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctgtccccccg

SEQ ID NO: 582682 - DNA, 447 bp, Homo sapiens; identical to SEQ ID NO: 535201
  misc_feature: HIJSMM301EY77G.18.9.A09.1.454.light.4.raw

SEQ ID NO: 582683 - DNA, 509 bp, Homo sapiens
  misc_feature: HIJSMM301DK8C4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaacggtaggaaagtacaaacgaactagtggctgcaccatctgtcttcatcttccccg

SEQ ID NO: 582684 - DNA, 503 bp, Homo sapiens
  misc_feature: HIJSMM301DLT17.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgcaactcacttacaacgaccgacacttgcgtattcggcggcgggaccaagctgaccgtcctaggtcagcccaaggctgccccctcggt

SEQ ID NO: 582685 - DNA, 486 bp, Homo sapiens; identical to SEQ ID NO: 535043
  misc_feature: HIJSMM301CBRZY.46.35.D02.1.454.light.4.raw

SEQ ID NO: 582686 - DNA, 514 bp, Homo sapiens; identical to SEQ ID NO: 538153
  misc_feature: HIJSMM301AKE17.17.37.D04.1.454.light.4.raw

SEQ ID NO: 582687 - DNA, 487 bp, Homo sapiens
  misc_feature: HIJSMM301DKY6Q.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtctcccccttagttcggcggagggaccaaggttgagatacaaacgaactgtggctgcaccatctgtcttcatt

SEQ ID NO: 582688 - DNA, 516 bp, Homo sapiens
  misc_feature: HIJSMM301CPKYL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgtcgacggacgaacggtaggaagtacgaaacgaaacgtaacgtggcgtcggcaccactactcgtcttctatcttccccg

SEQ ID NO: 582689 - DNA, 447 bp, Homo sapiens; identical to SEQ ID NO: 535020
  misc_feature: HIJSMM301C425D.18.9.A09.1.454.light.4.raw

SEQ ID NO: 582690 - DNA, 494 bp, Homo sapiens; identical to SEQ ID NO: 550612
  misc_feature: HIJSMM301A0XNR.49.72.G06.1.454.light.4.raw

SEQ ID NO: 582691 - DNA, 501 bp, Homo sapiens
  misc_feature: HIJSMM301CP59V.43.55.E11.1.454.light.4.raw
  modified_base (485)..(485): a, c, t, g, unknown or other
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggccaacgggacaacgtaggaaagtacaaacgaaactgtggcgtcgnaccatctgtcttcatt

SEQ ID NO: 582692 - DNA, 485 bp, Homo sapiens; identical to SEQ ID NO: 535880
  misc_feature: HIJSMM301DVA3J.7.75.G09.1.454.light.4.raw

SEQ ID NO: 582693 - DNA, 503 bp, Homo sapiens; identical to SEQ ID NO: 538884
  misc_feature: HIJSMM301AFKKC.27.78.H01.1.454.light.4.raw

SEQ ID NO: 582694 - DNA, 463 bp, Homo sapiens; identical to SEQ ID NO: 535062
  misc_feature: HIJSMM301CTWFM.11.73.G07.1.454.light.4.raw

SEQ ID NO: 582695 - DNA, 485 bp, Homo sapiens
  misc_feature: HIJSMM301BM9M0.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacgacgactggagattaaacgaaactgtggctgcaccatct

SEQ ID NO: 582696 - DNA, 447 bp, Homo sapiens; identical to SEQ ID NO: 535201
  misc_feature: HIJSMM301CRWSU.18.9.A09.1.454.light.4.raw

SEQ ID NO: 582697 - DNA, 483 bp, Homo sapiens
  misc_feature: HIJSMM301DDLXX.41.48.E04.1.454.light.4.raw
tctatactatcacgaccggtgctcgatttagagagcgtcacagagagaaggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccaattctgggaacacggccacctgaccatcaccggggtcgaggccgggatgaggccacctactattgtcacgtctgggagactggtgatgatcctgtggcgctattcggcggagggacgaagctgaccgtcctgggtcagccccg

SEQ ID NO: 582698 - DNA, 471 bp, Homo sapiens
  misc_feature: HIJSMM301EEX05.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggctgaggaccaaggtggagatcaaacgaactgtggctgcaccat

SEQ ID NO: 582699 - DNA, 353 bp, Homo sapiens; identical to SEQ ID NO: 536338
  misc_feature: HIJSMM301EPU45.3.11.A11.1.454.light.4.raw

SEQ ID NO: 582700 - DNA, 472 bp, Homo sapiens
  misc_feature: HIJSMM301DR0Q3.52.8.A08.1.454.light.4.raw
cgcagtacgacacgaccggtgctcgatttagcatactctacaggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagatcaagcgaactgtggctgcaccta

SEQ ID NO: 582701 - DNA, 493 bp, Homo sapiens; identical to SEQ ID NO: 535745
  misc_feature: HIJSMM301D6ENW.47.78.H01.1.454.light.4.raw

SEQ ID NO: 582702 - DNA, 488 bp, Homo sapiens; identical to SEQ ID NO: 535861
  misc_feature: HIJSMM301A4JPI.14.55.E11.1.454.light.4.raw

SEQ ID NO: 582703 - DNA, 494 bp, Homo sapiens; identical to SEQ ID NO: 534992
  misc_feature: HIJSMM301AUIAM.9.1.A01.1.454.light.4.raw

SEQ ID NO: 582704 - DNA, 499 bp, Homo sapiens
  misc_feature: HIJSMM301CZ4X2.43.53.E09.1.454.light.4.raw
tgtgagtagtcacgaccggtgctcgatttagagagagtgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatggttgggagttatagccttgtctcctggtaccaagtgcacccaggcaaagcccccaaactcatgatttatgagggcactaagcggcctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcaccgtctaggtcagccaaggccaaccctac

SEQ ID NO: 582705 - DNA, 510 bp, Homo sapiens
  misc_feature: HIJSMM301D58NP.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtctaagtcagcccaaggctgccccctggtcactctgttccccacctcct

SEQ ID NO: 582706 - DNA, 463 bp, Homo sapiens; identical to SEQ ID NO: 535008
  misc_feature: HIJSMM301ENJWT.10.9.A09.1.454.light.4.raw

SEQ ID NO: 582707 - DNA, 495 bp, Homo sapiens; identical to SEQ ID NO: 538673
  misc_feature: HIJSMM301BJ9XY.51.35.D02.1.454.light.4.raw

SEQ ID NO: 582708 - DNA, 518 bp, Homo sapiens; identical to SEQ ID NO: 535407
  misc_feature: HIJSMM301D1FCD.22.30.C08.1.454.light.4.raw

SEQ ID NO: 582709 - DNA, 477 bp, Homo sapiens
  misc_feature: HIJSMM301CY13V.17.1.A01.1.454.light.4.raw
cgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgcagactggggtcccatcaaggttcagcggcagtggatctggcacagatttcactctcaccatcagcagcctgcagcctgaagattttgcaacttattactgtctacaagattacgattaccctcggacgttcggtccaagggaccgaaggtggaggatcaaacgaactgtggctgcaccat

SEQ ID NO: 582710 - DNA, 484 bp, Homo sapiens; identical to SEQ ID NO: 579281
  misc_feature: HIJSMM301BRGFU.13.55.E11.1.454.light.4.raw

SEQ ID NO: 582711 - DNA, 485 bp, Homo sapiens; identical to SEQ ID NO: 536040
  misc_feature: HIJSMM301EHSG0.15.1.A01.1.454.light.4.raw

SEQ ID NO: 582712 - DNA, 481 bp, Homo sapiens
  misc_feature: HIJSMM301DSU76.5.42.D09.1.454.light.4.raw
atcagacacgcacgaccggtgctcgatttagacacatacgcagggaaagggggagtcagactcagtcaggacacagcatggacatgagggtccccgctcagctcctggggctcctgctgctctggctcccaggtgccgagggtgacatccagctgacccagacgccctccaccgtgtctgcattcgtaggagacagagtcacgatcacctgtcgggccagtcagaatattaacagatggttggcctggtatcaccagagaccaggagaagccccaaacctcctcatttttgatgcctccactttgaatggaggggtcccaccaacattcagcggcagtggatctgggacagaattcactctcaccatcagcagcctgcagcctgatgatgctgcaacttattactgtcaacaatataacagttattggacgttcggccaagggaccaaggtggaaatcaaacgaactgtaggctgcaccat

SEQ ID NO: 582713 - DNA, 507 bp, Homo sapiens; identical to SEQ ID NO: 535641
  misc_feature: HIJSMM301BN7U0.10.88.H11.1.454.light.4.raw

SEQ ID NO: 582714 - DNA, 444 bp, Homo sapiens; identical to SEQ ID NO: 535411
  misc_feature: HIJSMM301CDRN1.8.73.G07.1.454.light.4.raw

SEQ ID NO: 582715 - DNA, 508 bp, Homo sapiens; identical to SEQ ID NO: 551520
  misc_feature: HIJSMM301BEHWG.19.78.H01.1.454.light.4.raw

SEQ ID NO: 582716 - DNA, 494 bp, Homo sapiens; identical to SEQ ID NO: 579904
  misc_feature: HIJSMM301A4UQX.40.11.A11.1.454.light.4.raw

SEQ ID NO: 582717 - DNA, 509 bp, Homo sapiens
  misc_feature: HIJSMM301EIGXO.52.42.D09.1.454.light.4.raw
cgcagtacgacacgaccggtgctcgatttagacacatacgcagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgccccctcggtcta

SEQ ID NO: 582718 - DNA, 492 bp, Homo sapiens
  misc_feature: HIJSMM301EU4NY.52.31.C09.1.454.light.4.raw
  modified_base (243)..(243): a, c, t, g, unknown or other
cgcagtacgacacgaccggtgctcgatttagacgtctcatcaaggaaggaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatntgcttattggtaccagcagaggtcaggccaggcccctatattgatcatctatgaagacagcaaacgacccgctgggatccctcagagattctctggctccagctcagggacaatggccaccttgactatcactggggcccaggtggaggatgaagctgccttctattgttttctaacagacagcagtggtaatcatagagtgttcggcggagggaccaggctgaccgtcctaggtcagcccaagctccg

SEQ ID NO: 582719 - DNA, 401 bp, Homo sapiens
  misc_feature: HIJSMM301D4UV7.49.46.E02.1.454.light.4.raw
agtcgagagacacgaccggtgctcgatttagactcatctacagggaaagggggccaccctgtctttgtctccaggggacagtgccaccctctcctgcagggccagtcagagtgttagtagcttcttagcctggtaccaacagaaacctggccaggttcccaggctcctcgtctatgatgcgtccatcagggccactggcatcccagccaggttcagtggcagtgggtctgggacagacttcactctcaccatcagcagcctagagcctgaagactttgctagtttattactgtcagcagcgtagcaatttgatcaccttcggccaagggacacgactggaaattaaacgaactgtggctgcaccatctgtcttcatcttcccgccatctgatctctcgact

SEQ ID NO: 582720 - DNA, 445 bp, Homo sapiens
  misc_feature: HIJSMM301A6MXB.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctcgttcccaccctcctcagacgtatca

SEQ ID NO: 582721 - DNA, 506 bp, Homo sapiens
  misc_feature: HIJSMM301CS68Y.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcagggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcact

SEQ ID NO: 582722 - DNA, 495 bp, Homo sapiens
  misc_feature: HIJSMM301B1LUR.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagccagactagagcctgaagattttgctagtttattactgtcagcagcgtagcaactggcctcggacgttcggccaacgggaccgaaagtaggacatcaagcgaactagtggcgtgcaccatct

SEQ ID NO: 582723 - DNA, 497 bp, Homo sapiens
  misc_feature: HIJSMM301C40GP.52.57.F02.1.454.light.4.raw
cgcagtacgacacgaccggtgctcgatttagctcgatatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcactt

SEQ ID NO: 582724 - DNA, 516 bp, Homo sapiens
  misc_feature: HIJSMM301EVQJ3.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttcccg

SEQ ID NO: 582725 - DNA, 494 bp, Homo sapiens; identical to SEQ ID NO: 534992
  misc_feature: HIJSMM301DCRN9.9.1.A01.1.454.light.4.raw

SEQ ID NO: 582726 - DNA, 489 bp, Homo sapiens; identical to SEQ ID NO: 535091
  misc_feature: HIJSMM301CTS4V.47.36.D03.1.454.light.4.raw

SEQ ID NO: 582727 - DNA, 505 bp, Homo sapiens; identical to SEQ ID NO: 535503
  misc_feature: HIJSMM301CDCCK.8.28.C06.1.454.light.4.raw

SEQ ID NO: 582728 - DNA, 520 bp, Homo sapiens
  misc_feature: HIJSMM301ECXEF.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttcccacct

SEQ ID NO: 582729 - DNA, 498 bp, Homo sapiens
  misc_feature: HIJSMM301D7F4C.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatggttggggtttattactgcatgcaagctctaacaaactccttactacttttggccgacggggaccaagcgtggagatacaaacgaactgt

SEQ ID NO: 582730 - DNA, 495 bp, Homo sapiens; identical to SEQ ID NO: 535964
  misc_feature: HIJSMM301D2VBM.16.10.A10.1.454.light.4.raw

SEQ ID NO: 582731 - DNA, 486 bp, Homo sapiens; identical to SEQ ID NO: 535290
  misc_feature: HIJSMM301AHP6E.3.12.B01.1.454.light.4.raw

SEQ ID NO: 582732 - DNA, 473 bp, Homo sapiens
  misc_feature: HIJSMM301C97O0.15.8.A08.1.454.light.4.raw
  modified_base (346)..(346): a, c, t, g, unknown or other
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgnagtctgaagattttgctagtttattactgtcagcaatataacaagtggccattcactttcggcccagggaccaaagtggatatcaaacgaactgtggctgcaccatctgtcttcatcttcccgccat

SEQ ID NO: 582733 - DNA, 491 bp, Homo sapiens; identical to SEQ ID NO: 535194
  misc_feature: HIJSMM301CO22P.26.78.H01.1.454.light.4.raw

SEQ ID NO: 582734 - DNA, 517 bp, Homo sapiens
  misc_feature: HIJSMM301EYYNG.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggcctgccccctcggtcactctgttcccaccctcctccacg

SEQ ID NO: 582735 - DNA, 520 bp, Homo sapiens
  misc_feature: HIJSMM301D5VHR.13.77.G11.1.454.light.4.raw
tcacgtactacacgaccggtgctcgatttagctagtcactcaagggaaaggggtgtctgggcctaaggaagcagcactggtggtgcctcagccatggcctggaccgttctcctcctcggcctcctctctcactgcacaggctctgtgacctcctatgtgctgactcagccaccctcggtgtcagtggccccaggacagacggccaggattacctgtgggggaaacaacattggaagtaaaagtgtgcactggtaccagcagaagccaggccaggcccctgtgctggtcgtctatgttgatagcgaccggccctcagggatccctgagcgattctcgggctccaactctgggaacacggccactctgaccatcagtagggtcgaagccggggatgaggccgactattactgtcaggtgtgggatagtagtcgtgagcatgtggtattcggcggagggaccaaactgaccgtcctaggtcagcccaaggctgccccctcggtcactctgttcccgccctcct

SEQ ID NO: 582736 - DNA, 485 bp, Homo sapiens; identical to SEQ ID NO: 570096
  misc_feature: HIJSMM301DML4Q.46.35.D02.1.454.light.4.raw

SEQ ID NO: 582737 - DNA, 518 bp, Homo sapiens; identical to SEQ ID NO: 545878
  misc_feature: HIJSMM301AJW2H.41.25.C03.1.454.light.4.raw

SEQ ID NO: 582738 - DNA, 478 bp, Homo sapiens
  misc_feature: HIJSMM301BZNNP.7.81.H04.1.454.light.4.raw
cgtgtctctacacgaccggtgctcgatttagtagtgtagattcgcggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaactgatgatttgtcaacttactaactgtcaacagagttccactacccaactacacttcgtccgtcggcgtgagtagcatatagaagaagaagtatggcgtgca

SEQ ID NO: 582739 - DNA, 447 bp, Homo sapiens; identical to SEQ ID NO: 535882
  misc_feature: HIJSMM301DOZT5.18.9.A09.1.454.light.4.raw
  modified_base (429)..(429): a, c, t, g, unknown or other

SEQ ID NO: 582740 - DNA, 464 bp, Homo sapiens
  misc_feature: HIJSMM301ES4JN.49.8.A08.1.454.light.4.raw
agtcgagagacacgaccggtgctcgatttagcatactctacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacattattactgtcaacagtatgataatctcccgctcactttcgcggagggaccgaaggtggagatacaaacgaa

SEQ ID NO: 582741 - DNA, 489 bp, Homo sapiens
  misc_feature: HIJSMM301AP66S.14.55.E11.1.454.light.4.raw
  modified_base (459)..(459): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcanacgaactgtggctgcaccatctgtcttcta

SEQ ID NO: 582742 - DNA, 479 bp, Homo sapiens; identical to SEQ ID NO: 539141
  misc_feature: HIJSMM301CMZ27.7.67.G01.1.454.light.4.raw

SEQ ID NO: 582743 - DNA, 487 bp, Homo sapiens; identical to SEQ ID NO: 543396
  misc_feature: HIJSMM301BB0BR.46.26.C04.1.454.light.4.raw

SEQ ID NO: 582744 - DNA, 494 bp, Homo sapiens; identical to SEQ ID NO: 560412
  misc_feature: HIJSMM301C254J.53.31.C09.1.454.light.4.raw

SEQ ID NO: 582745 - DNA, 512 bp, Homo sapiens
  misc_feature: HIJSMM301B8FBL.18.37.D04.1.454.light.4.raw
  modified_base (429)..(429): a, c, t, g, unknown or other
  modified_base (477)..(477): a, c, t, g, unknown or other
  modified_base (508)..(508): a, c, t, g, unknown or other
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcaggtggaggctgaggatgttggggtttattactgcatgnaaactacacacggccgctcactttcggcggagggaccaaggtgagagntaacgaactacgtggcgtgcgaccactactnttcg

SEQ ID NO: 582746 - DNA, 486 bp, Homo sapiens
  misc_feature: HIJSMM301C3MHB.43.29.C07.1.454.light.4.raw
tgtgagtagtcacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactattggattggtacctgcagaagccagggcagtctccacagctcctgatctatttgggttctaatcggcctccggggtccctgacaggttcagtggcagtggatcaggcacagattttacactgaaaatcagcagagtggaggctgaggatgttggggtttattactgcatgcaagctctacaaactcccaggcggagggaccaaggtggagatcaaacgaactgtggctgcaccc

SEQ ID NO: 582747 - DNA, 383 bp, Homo sapiens; identical to SEQ ID NO: 447524
  misc_feature: HIJSMM301AI6V8.41.26.C04.1.454.light.4.raw

SEQ ID NO: 582748 - DNA, 476 bp, Homo sapiens; identical to SEQ ID NO: 537368
  misc_feature: HIJSMM301EZQAB.7.83.H06.1.454.light.4.raw

SEQ ID NO: 582749 - DNA, 500 bp, Homo sapiens
  misc_feature: HIJSMM301BZS55.17.29.C07.1.454.light.4.raw
cgtagactagcacgaccggtgctcgatttagagtgctacgaagggaaaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcgtgggaccaagctgaccgtcctaggtcagcccaaggctgccccccg

SEQ ID NO: 582750 - DNA, 479 bp, Homo sapiens; identical to SEQ ID NO: 535665
  misc_feature: HIJSMM301DEHRQ.12.10.A10.1.454.light.4.raw

SEQ ID NO: 582751 - DNA, 482 bp, Homo sapiens
  misc_feature: HIJSMM301AX8YC.5.15.B04.1.454.light.4.raw
atcagacacgcacgaccggtgctcgatttagacagtatatatccggcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatctagcagcctgcagcctgatgatgctgcaacttattactgtcaacaatataacagttattggacgttcggtccaagggaccaaggtggaaatacaaacgaactagtggctgcacca

SEQ ID NO: 582752 - DNA, 494 bp, Homo sapiens
  misc_feature: HIJSMM301DT5L6.10.60.F05.1.454.light.4.raw
catagtagtgcacgaccggtgctcgatttagtacgtcatcagggaaaggggggggtcgtcaggaggcagcactctcgggacgtctccaccatggcctgggctctgctcctcctcagcctcctcactcagggcacaggatcttgggctcagtctgccctgactcagcctcgctcagtgtccgggtctcctggacagtcagttaccatctcctgcactggaacctccaatgatgttggtggttatatctatgtctcctggtaccaacaacacgcaggcaaagcccccgaagtcatgatttatgatgtcagtaagcggccctcaggggtccctgaccgcttctctggctccaagtctggcaacacggcctccctgaccatctctggcctccaggctgaggatgaggctgactattattgctgctcatatgcaggcggacctggttccggtatgtcttcggaactgggaccacggtcaccgtctaggtcagcccaagg

SEQ ID NO: 582753 - DNA, 521 bp, Homo sapiens; identical to SEQ ID NO: 539470
  misc_feature: HIJSMM301DFNV1.27.23.C01.1.454.light.4.raw

SEQ ID NO: 582754 - DNA, 492 bp, Homo sapiens
  misc_feature: HIJSMM301ETM97.41.23.C01.1.454.light.4.raw
tctatactatcacgaccggtgctcgatttagtacacgtgattagggattgggggtgggtccaggaggcagaactctgggtgtctcaccatggcctggatccctctacttctccccctcctcactctctgcacaggctctgtgacctcctatgagctgacacagccaccctcggtgtcagtgtccccaggacagacggccaggatcgactgctctggagaagcattggcaacggaatatgcttattggtaccagcagaagccaggtcaggcccccatgttaataatatatagagacagtgagaggccctcagggatacctgagcgtatgtctggctccagctcagggacaacagtcacgttgaccatcactggagtccaggcagaagacgaggctgactatcactgtcaatcagcagacagtagtggttcttattgggtgttcggcggagagaccaagctgaccgtccttggtcagcccaaggctgccccccg

SEQ ID NO: 582755 - DNA, 487 bp, Homo sapiens
  misc_feature: HIJSMM301CKBE0.11.25.C03.1.454.light.4.raw
cgagagataccacgaccggtgctcgatttagtagtgtagatttgggtttggggctgggcctcaggaagcagcatcggaggtgcctcagccatggcatggatccctctcttcctcggcgtccttgcttactgcacaggattcgtggcctccgatgagttgactcagccaccctcagtgtccgtgtccccaggacagacagccagaatcccctgctctggaattgaattgagagataaatatacttgttggtatcaacagaagccaggccagtcccctgtattggtcatctatcaagatgtgaagcggccctcagggatccctgagcgattctctggctccaactctgggaacgcagccactctgaccatcagcgggacccaggctatggatgaggctgactattattgtcaggcgtgggacagcagcactgcccgttatgtcttcggaactgggaccaaggtcaccgtcttgagtcagccaaggccaa

SEQ ID NO: 582756 - DNA, 508 bp, Homo sapiens; identical to SEQ ID NO: 536388
  misc_feature: HIJSMM301ATMAO.11.57.F02.1.454.light.4.raw

SEQ ID NO: 582757 - DNA, 470 bp, Homo sapiens
  misc_feature: HIJSMM301A23V4.49.73.G07.1.454.light.4.raw
agtcgagagacacgaccggtgctcgatttagctctacgctcagggagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtggctgcacca

SEQ ID NO: 582758 - DNA, 354 bp, Homo sapiens; identical to SEQ ID NO: 535026
  misc_feature: HIJSMM301EU3JQ.19.22.B11.1.454.light.4.raw

SEQ ID NO: 582759 - DNA, 470 bp, Homo sapiens
  misc_feature: HIJSMM301EM9P8.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactatgtcagcaatatgattttgctcctccgagtgccacttttgcggggggaccaaggtggacatcaaacgaa

SEQ ID NO: 582760 - DNA, 501 bp, Homo sapiens; identical to SEQ ID NO: 535873
  misc_feature: HIJSMM301BIVGD.17.27.C05.1.454.light.4.raw

SEQ ID NO: 582761 - DNA, 498 bp, Homo sapiens
  misc_feature: HIJSMM301DDU68.9.53.E09.1.454.light.4.raw
tgatacgtctcacgaccggtgctcgatttagagagagtgtgttggggtttggggggggtcgacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggct

SEQ ID NO: 582762 - DNA, 485 bp, Homo sapiens; identical to SEQ ID NO: 550533
  misc_feature: HIJSMM301D5UJP.3.88.H11.1.454.light.4.raw

SEQ ID NO: 582763 - DNA, 502 bp, Homo sapiens
  misc_feature: HIJSMM301D62SZ.41.35.D02.1.454.light.4.raw
tctatactatcacgaccggtgctcgatttagcacacgatagttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtctaggtcagcccaaggctgccccctggt

SEQ ID NO: 582764 - DNA, 516 bp, Homo sapiens; identical to SEQ ID NO: 541685
  misc_feature: HIJSMM301DE7EL.13.55.E11.1.454.light.4.raw

SEQ ID NO: 582765 - DNA, 508 bp, Homo sapiens; identical to SEQ ID NO: 578410
  misc_feature: HIJSMM301D3MKN.19.72.G06.1.454.light.4.raw

SEQ ID NO: 582766 - DNA, 488 bp, Homo sapiens; identical to SEQ ID NO: 535568
  misc_feature: HIJSMM301ARYTY.21.4.A04.1.454.light.4.raw

SEQ ID NO: 582767 - DNA, 491 bp, Homo sapiens
  misc_feature: HIJSMM301C0O93.52.25.C03.1.454.light.4.raw
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtgggtcccatcaaggttcagcggcagtggatctgggacagaattcactctcacaatcagcagcctgcagcctgaagattttgcaacttattactgtcaacaccttaatagttactccttcactttcggccctcgggaccgaaagtggacatcaaaccgaactagtggctgcaccatcttgtctt

SEQ ID NO: 582768 - DNA, 501 bp, Homo sapiens
  misc_feature: HIJSMM301BWH8G.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggccctgggaccaaagtggatatcaaacgaactgtggctgcaccatctgtcttcatt

SEQ ID NO: 582769 - DNA, 485 bp, Homo sapiens; identical to SEQ ID NO: 536040
  misc_feature: HIJSMM301ECLHO.15.1.A01.1.454.light.4.raw

SEQ ID NO: 582770 - DNA, 495 bp, Homo sapiens; identical to SEQ ID NO: 543094
  misc_feature: HIJSMM301CPJ6N.22.57.F02.1.454.light.4.raw

SEQ ID NO: 582771 - DNA, 510 bp, Homo sapiens
  misc_feature: HIJSMM301CMR8I.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccgaacggaccaaggtaggaagtacaagacgaactagtggctgcaccaactctgtcttctatcttcccgt

SEQ ID NO: 582772 - DNA, 503 bp, Homo sapiens
  misc_feature: HIJSMM301DWON3.8.24.C02.1.454.light.4.raw
ctcgcgtgtccacgaccggtgctcgatttagtacagatcgttagggaaagggggggtcgtcaggaggcagcgctctcgggacgtctccaccatggcctgggctctgttattcctcaccctcctcactcagggcacagggtccagggcccaatctgccctgactcagcctgcctccgtgtctgggtcgcctggacagtccgtcaccatctcctgcactggaagcagcagtgacattggttcttataatcatgtctcctggtaccaacagcaccccggcagagcccccaaactcatcatttatgatgtcactgatcgcccctcaggggtttcgaatcgcttctctggctccaagtctggcaacacggcctccctgaccatctctgggctccaggctgaggacgaggctcattattattgcagttcatatacgaccagcagcactctcgtggtcttcggcggaggaccaagttgaccgtcctaagtcagcccaaggctgccccctc

SEQ ID NO: 582773 - DNA, 481 bp, Homo sapiens; identical to SEQ ID NO: 535993
  misc_feature: HIJSMM301BGNG9.21.25.C03.1.454.light.4.raw

SEQ ID NO: 582774 - DNA, 495 bp, Homo sapiens; identical to SEQ ID NO: 536931
  misc_feature: HIJSMM301EZXQV.10.33.C11.1.454.light.4.raw

SEQ ID NO: 582775 - DNA, 506 bp, Homo sapiens
  misc_feature: HIJSMM301D3FVV.18.78.H01.1.454.light.4.raw
  modified_base (499)..(499): a, c, t, g, unknown or other
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccccgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccntgtcact

SEQ ID NO: 582776 - DNA, 478 bp, Homo sapiens; identical to SEQ ID NO: 535129
  misc_feature: HIJSMM301EGZEI.11.11.A11.1.454.light.4.raw

SEQ ID NO: 582777 - DNA, 505 bp, Homo sapiens; identical to SEQ ID NO: 539292
  misc_feature: HIJSMM301D0DG2.19.85.H08.1.454.light.4.raw

SEQ ID NO: 582778 - DNA, 447 bp, Homo sapiens; identical to SEQ ID NO: 535020
  misc_feature: HIJSMM301B3PFQ.18.9.A09.1.454.light.4.raw

SEQ ID NO: 582779 - DNA, 473 bp, Homo sapiens
  misc_feature: HIJSMM301DP4AV.13.76.G10.1.454.light.4.raw
tcacgtactacacgaccggtgctcgatttagtcactcatacaggggtggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgccgctatgtcttcggaactgggaccaaggtcaccgtcctaagtcagcccaac

SEQ ID NO: 582780 - DNA, 518 bp, Homo sapiens; identical to SEQ ID NO: 539372
  misc_feature: HIJSMM301BUB23.7.86.H09.1.454.light.4.raw

SEQ ID NO: 582781 - DNA, 520 bp, Homo sapiens
  misc_feature: HIJSMM301BMPLW.41.87.H10.1.454.light.4.raw
tctatactatcacgaccggtgctcgatttagcagtactgcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtaacgttggcggttataactatgtctcctggtaccaacaacacccaggcaaagtccccaaactcataatttatgaggtctctaagcggccctcaggggtccctggtcgcttctctggctccaagtttggcaacacggcctccctgaccgtctctgggctccagagtgaagatgaggctgattactactgcgcctcatatgcaggcagcaacaatttcagggtatttggcggagggaccaagctgaccgtcctgggtcagcccaaggctgccccctcggtcactctgttccca

SEQ ID NO: 582782 - DNA, 512 bp, Homo sapiens
  misc_feature: HIJSMM301CSWZD.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccgccctcctcgagtataca

SEQ ID NO: 582783 - DNA, 494 bp, Homo sapiens; identical to SEQ ID NO: 534994
  misc_feature: HIJSMM301CINPV.27.78.H01.1.454.light.4.raw

SEQ ID NO: 582784 - DNA, 488 bp, Homo sapiens
  misc_feature: HIJSMM301EG7PA.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 582785 - DNA, 494 bp, Homo sapiens
  misc_feature: HIJSMM301DCLVV.17.10.A10.1.454.light.4.raw
  modified_base (201)..(201): a, c, t, g, unknown or other
  modified_base (345)..(345): a, c, t, g, unknown or other
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccgganaggaggtcaccatctcttgctctggaaacagctccggcatctcaactaaacatttttgctggtaccagcaattcccaggatcggccccccgactcctcatctatagaaatgatcatcggccctccggggtccctgaccgattcnctggctccatgtctggcacctcagcctccctgaccatcagtgggctccggtccgaggatgaggctgattattactgtgcaccgtgggatgacatcctgatggtccgtgttcggcggagggaccaggctgaccgtcctaagtcagacccg

SEQ ID NO: 582786 - DNA, 493 bp, Homo sapiens; identical to SEQ ID NO: 538503
  misc_feature: HIJSMM301ESNXS.9.1.A01.1.454.light.4.raw

SEQ ID NO: 582787 - DNA, 497 bp, Homo sapiens
  misc_feature: HIJSMM301B2OJ1.43.77.G11.1.454.light.4.raw
tgtgagtagtcacgaccggtgctcgatttagctagtcactcaagggaaagggggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattattgctgctcatatgcaggtagttacacttatgtcttcggaattgggacacggtcaccgtcctaggtcagcccaaggccaacccactgt

SEQ ID NO: 582788 - DNA, 497 bp, Homo sapiens; identical to SEQ ID NO: 535286
  misc_feature: HIJSMM301DIX41.18.59.F04.1.454.light.4.raw

SEQ ID NO: 582789 - DNA, 500 bp, Homo sapiens
  misc_feature: HIJSMM301CNIGG.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtggttcggcggggggaccgaaggctgaccgtcctaggtcagcccaaggctccg

SEQ ID NO: 582790 - DNA, 460 bp, Homo sapiens; identical to SEQ ID NO: 537107
  misc_feature: HIJSMM301D94B7.22.28.C06.1.454.light.4.raw

SEQ ID NO: 582791 - DNA, 486 bp, Homo sapiens
  misc_feature: HIJSMM301BAL86.47.29.C07.1.454.light.4.raw
agctcacgtacacgaccggtgctcgatttagagtgctacgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccagggaccaaactggacatcaaacgaactgtggctgcaccatctgt

SEQ ID NO: 582792 - DNA, 489 bp, Homo sapiens; identical to SEQ ID NO: 536013
  misc_feature: HIJSMM301DAFR4.26.23.C01.1.454.light.4.raw

SEQ ID NO: 582793 - DNA, 502 bp, Homo sapiens; identical to SEQ ID NO: 577285
  misc_feature: HIJSMM301AOGOC.9.71.G05.1.454.light.4.raw

SEQ ID NO: 582794 - DNA, 494 bp, Homo sapiens
  misc_feature: HIJSMM301BSI0Z.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggggaccgaaggtggagatcaaacgaactgtggctgcaccatctgt

SEQ ID NO: 582795 - DNA, 497 bp, Homo sapiens
  misc_feature: HIJSMM301CXQG1.21.22.B11.1.454.light.4.raw
tcgtcgctcgcacgaccggtgctcgatttagacgacagctcaggggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttggtgttcggcggagggccaaactgaccgtct

SEQ ID NO: 582796 - DNA, 511 bp, Homo sapiens; identical to SEQ ID NO: 544123
  misc_feature: HIJSMM301BUIFB.5.27.C05.1.454.light.4.raw

SEQ ID NO: 582797 - DNA, 486 bp, Homo sapiens
  misc_feature: HIJSMM301CIGLL.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaact

SEQ ID NO: 582798 - DNA, 489 bp, Homo sapiens; identical to SEQ ID NO: 542689
  misc_feature: HIJSMM301CH4AN.4.64.F09.1.454.light.4.raw

SEQ ID NO: 582799 - DNA, 506 bp, Homo sapiens; identical to SEQ ID NO: 534969
  misc_feature: HIJSMM301EHN9R.18.37.D04.1.454.light.4.raw

SEQ ID NO: 582800 - DNA, 512 bp, Homo sapiens
  misc_feature: HIJSMM301CJXL0.47.38.D05.1.454.light.4.raw
  modified_base (487)..(487): a, c, t, g, unknown or other
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtgacagtggatcaggcacagattttacgctgaaaatacagtagggtggaggctgaggatgttggggttttagttacttgcatgcaagttactacaaaacttaccttacaccttttagttccgcgggacggaacggactgnggatacaacaaaccgatggcgtgca

SEQ ID NO: 582801 - DNA, 486 bp, Homo sapiens; identical to SEQ ID NO: 537617
  misc_feature: HIJSMM301DRURU.10.53.E09.1.454.light.4.raw

SEQ ID NO: 582802 - DNA, 493 bp, Homo sapiens; identical to SEQ ID NO: 535047
  misc_feature: HIJSMM301EOXNO.16.53.E09.1.454.light.4.raw

SEQ ID NO: 582803 - DNA, 498 bp, Homo sapiens
  misc_feature: HIJSMM301ASLUY.43.61.F06.1.454.light.4.raw
tgtgagtagtcacgaccggtgctcgatttagctacgctctaagggaaagggggaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtactacttttggccaggggaccaagctaagaaatacaaacgaactgtggctgcaccatctgtctt

SEQ ID NO: 582804 - DNA, 492 bp, Homo sapiens; identical to SEQ ID NO: 537395
  misc_feature: HIJSMM301DWX4J.16.73.G07.1.454.light.4.raw

SEQ ID NO: 582805 - DNA, 497 bp, Homo sapiens
  misc_feature: HIJSMM301A1EXM.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgtcgcacggacaaggtaggacgagtcaacgaactagtaggtcgtgtcgaccaactctgtcttt

SEQ ID NO: 582806 - DNA, 441 bp, Homo sapiens; identical to SEQ ID NO: 534971
  misc_feature: HIJSMM301D76C7.11.3.A03.1.454.light.4.raw

SEQ ID NO: 582807 - DNA, 500 bp, Homo sapiens
  misc_feature: HIJSMM301CGOCF.41.42.D09.1.454.light.4.raw
tctatactatcacgaccggtgctcgatttagacacatacgcagggaaaggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccaagggaccaaggtggaaatcaaacgaactgtggctgcaccatctgtcttcta

SEQ ID NO: 582808 - DNA, 496 bp, Homo sapiens
  misc_feature: HIJSMM301A64IJ.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactatcactgtcaatcagcagacagtagtggttcttattgggtgttcggcggagggaccaagctgaccgtccttggtcagcccaaggctgccccctcggtca

SEQ ID NO: 582809 - DNA, 499 bp, Homo sapiens; identical to SEQ ID NO: 548282
  misc_feature: HIJSMM301BBEK4.48.83.H06.1.454.light.4.raw

SEQ ID NO: 582810 - DNA, 477 bp, Homo sapiens
  misc_feature: HIJSMM301AQGLD.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactagtggctgca

SEQ ID NO: 582811 - DNA, 504 bp, Homo sapiens
  misc_feature: HIJSMM301BIR02.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggtaggaccaaggtggaggtcaaacgaactgtggctgcaccatctgtcttcta

SEQ ID NO: 582812 - DNA, 488 bp, Homo sapiens
  misc_feature: HIJSMM301BJW5B.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatacaaacgaa

SEQ ID NO: 582813 - DNA, 506 bp, Homo sapiens
  misc_feature: HIJSMM301DK6Y7.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctcctgaccatctctgggctccaggctgaggacgaggctgattattactgcagctcatatacaagcagcagcactcaagtcttcggaactgggaccaaggtcaccgtctaggtcacgcccaaggcccaacccactgtcta

SEQ ID NO: 582814 - DNA, 495 bp, Homo sapiens
  misc_feature: HIJSMM301BD8PE.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtctgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctcgccccctcggtcactctcgttcccgccct

SEQ ID NO: 582815 - DNA, 488 bp, Homo sapiens; identical to SEQ ID NO: 570811
  misc_feature: HIJSMM301CO6J6.21.65.F10.1.454.light.4.raw

SEQ ID NO: 582816 - DNA, 499 bp, Homo sapiens; identical to SEQ ID NO: 537739
  misc_feature: HIJSMM301ECMO4.12.86.H09.1.454.light.4.raw

SEQ ID NO: 582817 - DNA, 459 bp, Homo sapiens
  misc_feature: HIJSMM301CLVUH.52.49.E05.1.454.light.4.raw
cgcagtacgacacgaccggtgctcgatttagagcgactagcaacacacaaaggggagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaataccctcatacacttttggccaggggaccaagctggagat

SEQ ID NO: 582818 - DNA, 498 bp, Homo sapiens; identical to SEQ ID NO: 572965
  misc_feature: HIJSMM301CIPKS.22.9.A09.1.454.light.4.raw

SEQ ID NO: 582819 - DNA, 488 bp, Homo sapiens; identical to SEQ ID NO: 539884
  misc_feature: HIJSMM301CMS0I.7.85.H08.1.454.light.4.raw

SEQ ID NO: 582820 - DNA, 506 bp, Homo sapiens
  misc_feature: HIJSMM301BUD0K.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaacgtcgacgtacgcacctacgtcgtacacgaccgacgacccaccctacg

SEQ ID NO: 582821 - DNA, 514 bp, Homo sapiens
  misc_feature: HIJSMM301DYMKB.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctcg

SEQ ID NO: 582822 - DNA, 491 bp, Homo sapiens
  misc_feature: HIJSMM301AR3PZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgtaacttactactgtcaacagagttacagtacccccctcacttcggcggagggaccgaaggcggaggatcagacgaactagtggctgcaccatctgtcttcat

SEQ ID NO: 582823 - DNA, 497 bp, Homo sapiens; identical to SEQ ID NO: 568167
  misc_feature: HIJSMM301CNKY8.3.33.C11.1.454.light.4.raw

SEQ ID NO: 582824 - DNA, 492 bp, Homo sapiens; identical to SEQ ID NO: 557028
  misc_feature: HIJSMM301DCYGH.51.6.A06.1.454.light.4.raw

SEQ ID NO: 582825 - DNA, 512 bp, Homo sapiens; identical to SEQ ID NO: 564561
  misc_feature: HIJSMM301CVXL8.41.9.A09.1.454.light.4.raw

SEQ ID NO: 582826 - DNA, 513 bp, Homo sapiens; identical to SEQ ID NO: 552442
  misc_feature: HIJSMM301BXG6C.47.85.H08.1.454.light.4.raw

SEQ ID NO: 582827 - DNA, 501 bp, Homo sapiens
  misc_feature: HIJSMM301A326Q.48.61.F06.1.454.light.4.raw
agtatacatacacgaccggtgctcgatttagctacgctctaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaca

SEQ ID NO: 582828 - DNA, 513 bp, Homo sapiens
  misc_feature: HIJSMM301EJEPF.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgccccctcggtcactctcg

SEQ ID NO: 582829 - DNA, 483 bp, Homo sapiens; identical to SEQ ID NO: 540738
  misc_feature: HIJSMM301AOFV3.48.85.H08.1.454.light.4.raw

SEQ ID NO: 582830 - DNA, 481 bp, Homo sapiens; identical to SEQ ID NO: 535993
  misc_feature: HIJSMM301EGMW2.21.25.C03.1.454.light.4.raw

SEQ ID NO: 582831 - DNA, 487 bp, Homo sapiens; identical to SEQ ID NO: 537220
  misc_feature: HIJSMM301DGHKQ.16.53.E09.1.454.light.4.raw

SEQ ID NO: 582832 - DNA, 492 bp, Homo sapiens
  misc_feature: HIJSMM301BEWI6.12.85.H08.1.454.light.4.raw
atacgacgtacacgaccggtgctcgatttagtatcactcagtcgcggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagctaccctctttgtcttcggaagtgggaccaaggtcaccgtcctacgtcagcccaagg

SEQ ID NO: 582833 - DNA, 493 bp, Homo sapiens; identical to SEQ ID NO: 536246
  misc_feature: HIJSMM301EHHIX.49.66.F11.1.454.light.4.raw

SEQ ID NO: 582834 - DNA, 497 bp, Homo sapiens; identical to SEQ ID NO: 535286
  misc_feature: HIJSMM301ANUS1.18.59.F04.1.454.light.4.raw

SEQ ID NO: 582835 - DNA, 416 bp, Homo sapiens; identical to SEQ ID NO: 545902
  misc_feature: HIJSMM301C5M8J.18.78.H01.1.454.light.4.raw

SEQ ID NO: 582836 - DNA, 507 bp, Homo sapiens
  misc_feature: HIJSMM301CU0OT.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtccctcgagtcagcccaaggctgccccccg

SEQ ID NO: 582837 - DNA, 444 bp, Homo sapiens; identical to SEQ ID NO: 535027
  misc_feature: HIJSMM301CZNMZ.8.73.G07.1.454.light.4.raw

SEQ ID NO: 582838 - DNA, 471 bp, Homo sapiens; identical to SEQ ID NO: 537461
  misc_feature: HIJSMM301AQKCK.7.81.H04.1.454.light.4.raw

SEQ ID NO: 582839 - DNA, 520 bp, Homo sapiens; identical to SEQ ID NO: 543998
  misc_feature: HIJSMM301C66KC.27.23.C01.1.454.light.4.raw

SEQ ID NO: 582840 - DNA, 495 bp, Homo sapiens
  misc_feature: HIJSMM301BDBGG.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatggcactgcgatcttcggcggagggaccaagctgaccgtcctgggtcagcccaaggctgccccctcggtcactcc

SEQ ID NO: 582841 - DNA, 514 bp, Homo sapiens; identical to SEQ ID NO: 539906
  misc_feature: HIJSMM301C0WE9.16.85.H08.1.454.light.4.raw

SEQ ID NO: 582842 - DNA, 495 bp, Homo sapiens
  misc_feature: HIJSMM301DPUFI.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagatttttacactgacaatcaacagagtggaggctgaggatgttggggtttattactgcgtgcaaagtctgcaaactatcaccttcggccaagggacacgactggagattaaacgaactagtggctgcacc

SEQ ID NO: 582843 - DNA, 518 bp, Homo sapiens
  misc_feature: HIJSMM301BABGD.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgtcactctccg

SEQ ID NO: 582844 - DNA, 499 bp, Homo sapiens
  misc_feature: HIJSMM301BX0FJ.48.41.D08.1.454.light.4.raw
agtatacatacacgaccggtgctcgatttagtcacgcgagaaagggaaaggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 582845 - DNA, 492 bp, Homo sapiens; identical to SEQ ID NO: 547275
  misc_feature: HIJSMM301BD3XZ.43.53.E09.1.454.light.4.raw

SEQ ID NO: 582846 - DNA, 493 bp, Homo sapiens
  misc_feature: HIJSMM301AL0SR.51.28.C06.1.454.light.4.raw
cgatcgtatacacgaccggtgctcgatttagagctcacgtattgggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccgaagctgaccgtcctcggtcagcccaaggctgccccctcggtcact

SEQ ID NO: 582847 - DNA, 499 bp, Homo sapiens
  misc_feature: HIJSMM301EIZ2O.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactagtggctgcaccatctgtcttcatcttccccg

SEQ ID NO: 582848 - DNA, 473 bp, Homo sapiens; identical to SEQ ID NO: 580614
  misc_feature: HIJSMM301BFSGB.18.59.F04.1.454.light.4.raw

SEQ ID NO: 582849 - DNA, 484 bp, Homo sapiens
  misc_feature: HIJSMM301BSS7V.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggtccaagggaccgaacggtggaaatacaaacgaactagtgg

SEQ ID NO: 582850 - DNA, 506 bp, Homo sapiens
  misc_feature: HIJSMM301B06DW.15.1.A01.1.454.light.4.raw
  modified_base (475)..(475): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtctccccgngtccagcccaaggctgccccctcggtccact

SEQ ID NO: 582851 - DNA, 516 bp, Homo sapiens; identical to SEQ ID NO: 541685
  misc_feature: HIJSMM301CU85K.13.55.E11.1.454.light.4.raw

SEQ ID NO: 582852 - DNA, 497 bp, Homo sapiens
  misc_feature: HIJSMM301DA0ZJ.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggcgtgcacc

SEQ ID NO: 582853 - DNA, 477 bp, Homo sapiens
  misc_feature: HIJSMM301DJEYT.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaaggaaaacgcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccgaggggacgaagctggagatcgaacgaactgtggctgcaccatctgtcttcatcttcccgccatcctgagacacgcgag

SEQ ID NO: 582854 - DNA, 478 bp, Homo sapiens
  misc_feature: HIJSMM301EQMEH.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtgggtcccatcaaggttcagtggcagtggatctgggacagatttcactctcaccatccgcagtctgcaacctgaagattttgcaatttattactgtcaagagactcacaatggaggcacttttggccaggggaccaaagctggaagaggaaacgaactgtggctgcaccat

SEQ ID NO: 582855 - DNA, 447 bp, Homo sapiens; identical to SEQ ID NO: 535201
  misc_feature: HIJSMM301DPVN4.18.9.A09.1.454.light.4.raw

SEQ ID NO: 582856 - DNA, 502 bp, Homo sapiens
  misc_feature: HIJSMM301AMXGW.22.20.B09.1.454.light.4.raw
acatacgcgtcacgaccggtgctcgatttagtgtagtgtgaaggggagagctgctcagttaggacccagagggaaccatggaaaccccagcgcagcttctcttcctcctgctactctggctcccagatattactggagacgttgtcttgacgcagtctccaggcaccctgtcgctgtctccaggggaaagagccaccctctcgtgtaaggccagtcagaatgttaacaacagatatgtagcctggtatcagcagagacctggccagtctcccgttctcctcgtctttggtgcggccgacagggccacgggcatccctgacagattcagtggcagtgggtccgggtcagactatctgctcaccatcggcggtctggaacctgaagattctgcactatattactgtcagtctttatgttaattcacctccgtcgtacatctttcggccgagggaccaagctggagatcaaacgaactgtggctgcaccatctgtcttcattccc

SEQ ID NO: 582857 - DNA, 487 bp, Homo sapiens; identical to SEQ ID NO: 553099
  misc_feature: HIJSMM301DR5MX.13.5.A05.1.454.light.4.raw

SEQ ID NO: 582858 - DNA, 487 bp, Homo sapiens; identical to SEQ ID NO: 554782
  misc_feature: HIJSMM301DPT6V.46.35.D02.1.454.light.4.raw

SEQ ID NO: 582859 - DNA, 493 bp, Homo sapiens; identical to SEQ ID NO: 553749
  misc_feature: HIJSMM301AFXOK.10.79.H02.1.454.light.4.raw

SEQ ID NO: 582860 - DNA, 484 bp, Homo sapiens
  misc_feature: HIJSMM301DYDG1.52.53.E09.1.454.light.4.raw
  modified_base (436)..(436): a, c, t, g, unknown or other
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggngttcggcggagggaccaagttgaccgtcctaggtcagcccaaggctcg

SEQ ID NO: 582861 - DNA, 508 bp, Homo sapiens; identical to SEQ ID NO: 551099
  misc_feature: HIJSMM301CP3GL.8.28.C06.1.454.light.4.raw

SEQ ID NO: 582862 - DNA, 502 bp, Homo sapiens
  misc_feature: HIJSMM301DC0U6.15.57.F02.1.454.light.4.raw
tctacgtagccacgaccggtgctcgatttagctcgatatagttgggtttgggggctttgcctgggctctgctgctcctcaccctcctcactcagggcacagggtcctgggcccagtctgccctgactcagcctgcctccgtgtctgggtctcccggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgttcccgccctcctcgctacgtaga

SEQ ID NO: 582863 - DNA, 482 bp, Homo sapiens; identical to SEQ ID NO: 566713
  misc_feature: HIJSMM301CPLEJ.48.12.B01.1.454.light.4.raw

SEQ ID NO: 582864 - DNA, 491 bp, Homo sapiens; identical to SEQ ID NO: 563397
  misc_feature: HIJSMM301EPJRG.41.44.D11.1.454.light.4.raw

SEQ ID NO: 582865 - DNA, 502 bp, Homo sapiens; identical to SEQ ID NO: 562394
  misc_feature: HIJSMM301BSZZQ.7.71.G05.1.454.light.4.raw

SEQ ID NO: 582866 - DNA, 502 bp, Homo sapiens
  misc_feature: HIJSMM301AM21B.48.23.C01.1.454.light.4.raw
agtatacatacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatgggcccaggtggacgatgaggctgactactactgttcctcaacagacagtagtggtgatcgagggctgttcggcggagggaccaagctgaccgtcctaagtcagcccaaggctgccccctcggtcactctcg

SEQ ID NO: 582867 - DNA, 528 bp, Homo sapiens
  misc_feature: HIJSMM301BRUK5.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtggggcgaggtccaggccccaacggcccaacccccactcgtcactctccg

SEQ ID NO: 582868 - DNA, 505 bp, Homo sapiens; identical to SEQ ID NO: 541350
  misc_feature: HIJSMM301AR781.2.71.G05.1.454.light.4.raw

SEQ ID NO: 582869 - DNA, 447 bp, Homo sapiens; identical to SEQ ID NO: 535201
  misc_feature: HIJSMM301EKMHO.18.9.A09.1.454.light.4.raw

SEQ ID NO: 582870 - DNA, 504 bp, Homo sapiens
  misc_feature: HIJSMM301CKU8B.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagccaaggctgccccctcggtcactctgttcccaccctcctccgtgt

SEQ ID NO: 582871 - DNA, 516 bp, Homo sapiens
  misc_feature: HIJSMM301BLZYC.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgctagtttattactgtcaacatcgtaccgagtcggccgtccgggggccacgtttccggccgtcgggaccgaaggtggagatacaaacgaactagtggctgcacatctgtcttcta

SEQ ID NO: 582872 - DNA, 485 bp, Homo sapiens; identical to SEQ ID NO: 535880
  misc_feature: HIJSMM301D2M11.7.75.G09.1.454.light.4.raw

SEQ ID NO: 582873 - DNA, 475 bp, Homo sapiens
  misc_feature: HIJSMM301DY8LD.17.1.A01.1.454.light.4.raw
cgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgcagactggggtcccatcaaggttcagcggcagtggatctggcacagatttcactctcaccatcagcagcctgcagcctgaagattttgcaacttattactgtctacaagattacgattaccctcggacgttcggccaggaccgaaggtaggagatcaaacgaactagtggctgcaccat

SEQ ID NO: 582874 - DNA, 488 bp, Homo sapiens; identical to SEQ ID NO: 536554
  misc_feature: HIJSMM301DM31N.26.37.D04.1.454.light.4.raw

SEQ ID NO: 582875 - DNA, 489 bp, Homo sapiens; identical to SEQ ID NO: 543840
  misc_feature: HIJSMM301BN8WS.12.88.H11.1.454.light.4.raw

SEQ ID NO: 582876 - DNA, 520 bp, Homo sapiens; identical to SEQ ID NO: 563950
  misc_feature: HIJSMM301BQATU.27.23.C01.1.454.light.4.raw

SEQ ID NO: 582877 - DNA, 499 bp, Homo sapiens
  misc_feature: HIJSMM301BTCC6.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggcccaacccc

SEQ ID NO: 582878 - DNA, 500 bp, Homo sapiens; identical to SEQ ID NO: 548633
  misc_feature: HIJSMM301AR6OP.17.27.C05.1.454.light.4.raw

SEQ ID NO: 582879 - DNA, 487 bp, Homo sapiens; identical to SEQ ID NO: 537079
  misc_feature: HIJSMM301DE6C2.14.55.E11.1.454.light.4.raw

SEQ ID NO: 582880 - DNA, 488 bp, Homo sapiens
  misc_feature: HIJSMM301EL8ET.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagcagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaagttgaacatcaatcgaactgtggctgcaccat

SEQ ID NO: 582881 - DNA, 517 bp, Homo sapiens; identical to SEQ ID NO: 537838
  misc_feature: HIJSMM301BGAR1.7.86.H09.1.454.light.4.raw

SEQ ID NO: 582882 - DNA, 506 bp, Homo sapiens
  misc_feature: HIJSMM301CSV3L.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggccctgggaccaaagtaagatagtcaaacgaactagtggctgcaccatctgtctt

SEQ ID NO: 582883 - DNA, 505 bp, Homo sapiens
  misc_feature: HIJSMM301C6BX5.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtattggtggagggaccaagctgaccgtcctaggtcagcccaaggctgccccctggt

SEQ ID NO: 582884 - DNA, 492 bp, Homo sapiens; identical to SEQ ID NO: 535126
  misc_feature: HIJSMM301EWCIS.18.11.A11.1.454.light.4.raw

SEQ ID NO: 582885 - DNA, 516 bp, Homo sapiens
  misc_feature: HIJSMM301ALTQE.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaccgaacggtaggaaatacgaaaacgaaacctagtaggctgcaccatctgtcttctatcttccccg

SEQ ID NO: 582886 - DNA, 487 bp, Homo sapiens; identical to SEQ ID NO: 541187
  misc_feature: HIJSMM301AW3PW.43.36.D03.1.454.light.4.raw

SEQ ID NO: 582887 - DNA, 493 bp, Homo sapiens; identical to SEQ ID NO: 554221
  misc_feature: HIJSMM301BW7A7.9.1.A01.1.454.light.4.raw

SEQ ID NO: 582888 - DNA, 473 bp, Homo sapiens
  misc_feature: HIJSMM301CR7MD.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaagggacacgactggagattaaacgaa

SEQ ID NO: 582889 - DNA, 513 bp, Homo sapiens
  misc_feature: HIJSMM301A8QDX.49.16.B05.1.454.light.4.raw
agtcgagagacacgaccggtgctcgatttagagctcacgtaagggggtgggtccaggaggcagaactctgggtgtctcaccatggcctggatccctctacttctccccctcctcactctctgcacaggttctgaggcctcctatgagctgacacagccaccctcggtgtcagtgtccccaggacagacggccaggatcacctgttttggagatacgttacgaaaggaatatggtcattggtaccagcagaagacaggccaggcccctgtcttggtggtatataaagacagtgagaggccctcagggatccctgagcgattctctggctccagctcagggacaacagtcacgttgaccatcagtggagtccaggcagaagacgaggctgactattattgtcaatcagcagacaccggtggtacttatcgggtgttcggcggagggaccaagctgaccgtctaggtcagcccaaggctgccccctcggtcactctgttcccgccctcctctctcc

SEQ ID NO: 582890 - DNA, 508 bp, Homo sapiens
  misc_feature: HIJSMM301DE8UC.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagccaaggctgccccctcggtcactctgtt

SEQ ID NO: 582891 - DNA, 511 bp, Homo sapiens
  misc_feature: HIJSMM301EXDPV.51.82.H05.1.454.light.4.raw
cgatcgtatacacgaccggtgctcgatttagtcgagctctctcgcgggcacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgacccg

SEQ ID NO: 582892 - DNA, 480 bp, Homo sapiens; identical to SEQ ID NO: 555806
  misc_feature: HIJSMM301A6AJV.7.76.G10.1.454.light.4.raw

SEQ ID NO: 582893 - DNA, 505 bp, Homo sapiens; identical to SEQ ID NO: 541350
  misc_feature: HIJSMM301ANEMR.2.71.G05.1.454.light.4.raw

SEQ ID NO: 582894 - DNA, 520 bp, Homo sapiens
  misc_feature: HIJSMM301ARD2D.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccgaaggtgaccgtcctaagtcagcccaacggctgccccctccggtcactctgttcccaccctcct

SEQ ID NO: 582895 - DNA, 494 bp, Homo sapiens; identical to SEQ ID NO: 534994
  misc_feature: HIJSMM301CZTX2.27.78.H01.1.454.light.4.raw

SEQ ID NO: 582896 - DNA, 496 bp, Homo sapiens; identical to SEQ ID NO: 537925
  misc_feature: HIJSMM301C8OQ5.22.14.B03.1.454.light.4.raw

SEQ ID NO: 582897 - DNA, 487 bp, Homo sapiens
  misc_feature: HIJSMM301A610H.49.23.C01.1.454.light.4.raw
agtcgagagacacgaccggtgctcgatttagtacacgtgattagggattggggagtcagacccagtcaggacacagcatggacatgagggtccccgctcagctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtgctgcaccatctgtt

SEQ ID NO: 582898 - DNA, 505 bp, Homo sapiens
  misc_feature: HIJSMM301A1JRM.13.25.C03.1.454.light.4.raw
tcacgtactacacgaccggtgctcgatttagtagtgtagatttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcact

SEQ ID NO: 582899 - DNA, 514 bp, Homo sapiens; identical to SEQ ID NO: 565828
  misc_feature: HIJSMM301AYIPT.8.43.D10.1.454.light.4.raw

SEQ ID NO: 582900 - DNA, 501 bp, Homo sapiens
  misc_feature: HIJSMM301B16UX.48.24.C02.1.454.light.4.raw
agtatacatacacgaccggtgctcgatttagtacagatcgttagggaaagggaaggggatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaaggacacgactggagattaaacgaactgtggctgcacatctgtcttcatcttcccg

SEQ ID NO: 582901 - DNA, 486 bp, Homo sapiens
  misc_feature: HIJSMM301AYW9W.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccgaagggaccaaggtggatatcagacgaa

SEQ ID NO: 582902 - DNA, 501 bp, Homo sapiens; identical to SEQ ID NO: 550139
  misc_feature: HIJSMM301CTIQ0.15.56.F01.1.454.light.4.raw

SEQ ID NO: 582903 - DNA, 523 bp, Homo sapiens
  misc_feature: HIJSMM301CS34A.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggtgttcggcggagggaccaggctgaccgtcctaggtcagcccaaaggctgccccctccggtcacctctcgtcccaccct

SEQ ID NO: 582904 - DNA, 510 bp, Homo sapiens
  misc_feature: HIJSMM301AG3PF.52.34.D01.1.454.light.4.raw
  modified_base (503)..(503): a, c, t, g, unknown or other
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagtattttgctagtttatactgtcagcagcgtagcaactggcctccgatccaccttcggaccgaacggacacgactggagtaattaaacgaactgtggctgcaccatctgtcttnacttccg

SEQ ID NO: 582905 - DNA, 502 bp, Homo sapiens; identical to SEQ ID NO: 575223
  misc_feature: HIJSMM301D6IE1.27.78.H01.1.454.light.4.raw

SEQ ID NO: 582906 - DNA, 508 bp, Homo sapiens
  misc_feature: HIJSMM301C0B8H.49.10.A10.1.454.light.4.raw
agtcgagagacacgaccggtgctcgatttagcgtcgatctcagggcacgaccggtgctcgatttagctctacgctcagggcacgaccggtgctcgatttagagtatacatattgggtttgggggctgtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcaacg

SEQ ID NO: 582907 - DNA, 488 bp, Homo sapiens
  misc_feature: HIJSMM301DAED4.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaaacgaa

SEQ ID NO: 582908 - DNA, 453 bp, Homo sapiens
  misc_feature: HIJSMM301B91FQ.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttggaactgggaccaaggtcaccgtcctaggtcagcccaaggccaaccccactgtcactctgttcccgccctcctccatactcgta

SEQ ID NO: 582909 - DNA, 496 bp, Homo sapiens; identical to SEQ ID NO: 548663
  misc_feature: HIJSMM301A3EUX.40.57.F02.1.454.light.4.raw

SEQ ID NO: 582910 - DNA, 488 bp, Homo sapiens; identical to SEQ ID NO: 535861
  misc_feature: HIJSMM301D7O30.14.55.E11.1.454.light.4.raw

SEQ ID NO: 582911 - DNA, 446 bp, Homo sapiens
  misc_feature: HIJSMM301BXN9M.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcgggcggagggaccaagctgaccgtctaagtcagcccaaggctcgccccctcggtcactctcgttcccaccctcctccgtgtctgat

SEQ ID NO: 582912 - DNA, 484 bp, Homo sapiens; identical to SEQ ID NO: 535240
  misc_feature: HIJSMM301C41XN.47.60.F05.1.454.light.4.raw

SEQ ID NO: 582913 - DNA, 470 bp, Homo sapiens; identical to SEQ ID NO: 535302
  misc_feature: HIJSMM301AJ19Q.13.76.G10.1.454.light.4.raw

SEQ ID NO: 582914 - DNA, 474 bp, Homo sapiens; identical to SEQ ID NO: 570103
  misc_feature: HIJSMM301EL0HD.13.48.E04.1.454.light.4.raw

SEQ ID NO: 582915 - DNA, 513 bp, Homo sapiens; identical to SEQ ID NO: 575973
  misc_feature: HIJSMM301AFK2W.43.23.C01.1.454.light.4.raw

SEQ ID NO: 582916 - DNA, 489 bp, Homo sapiens; identical to SEQ ID NO: 535139
  misc_feature: HIJSMM301EQIF2.14.55.E11.1.454.light.4.raw

SEQ ID NO: 582917 - DNA, 485 bp, Homo sapiens; identical to SEQ ID NO: 535606
  misc_feature: HIJSMM301C3XXA.47.46.E02.1.454.light.4.raw

SEQ ID NO: 582918 - DNA, 515 bp, Homo sapiens; identical to SEQ ID NO: 557280
  misc_feature: HIJSMM301EIXYL.15.86.H09.1.454.light.4.raw

SEQ ID NO: 582919 - DNA, 489 bp, Homo sapiens
  misc_feature: HIJSMM301A1UI8.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccgaacggaccgaacggtaggaagtacaaacgaactacgtggcgtgcacca

SEQ ID NO: 582920 - DNA, 454 bp, Homo sapiens; identical to SEQ ID NO: 534964
  misc_feature: HIJSMM301C6WZ8.19.86.H09.1.454.light.4.raw

SEQ ID NO: 582921 - DNA, 513 bp, Homo sapiens
  misc_feature: HIJSMM301DBLS2.17.33.C11.1.454.light.4.raw
  modified_base (481)..(481): a, c, t, g, unknown or other
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaaacctggacaagcacccagggcactcatttatagtacaaacaacaaacactcctggaccctgcccgattctcaggctccctccttggggcaaagctgccctgacactgtctggtgtgcagcctgaggacgaggctgactattactgcctactctactttggtggtgctgtgctattcggcgggagggaccaagctgaccgtcttaagtcagcccaaggntgccccctcggtcactctgttcccaccctcct

SEQ ID NO: 582922 - DNA, 418 bp, Homo sapiens
  misc_feature: HIJSMM301CJU66.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctcgttcccaccctcctccatactcgta

SEQ ID NO: 582923 - DNA, 504 bp, Homo sapiens
  misc_feature: HIJSMM301EQFF4.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttcttggggcgttcggccaagggaccaaggtggaaatacaaacgaactgtgctgcacatctgtcttcatcctccccg

SEQ ID NO: 582924 - DNA, 494 bp, Homo sapiens; identical to SEQ ID NO: 534994
  misc_feature: HIJSMM301DEPE9.27.78.H01.1.454.light.4.raw

SEQ ID NO: 582925 - DNA, 480 bp, Homo sapiens; identical to SEQ ID NO: 535630
  misc_feature: HIJSMM301A4AII.40.59.F04.1.454.light.4.raw

SEQ ID NO: 582926 - DNA, 487 bp, Homo sapiens; identical to SEQ ID NO: 546036
  misc_feature: HIJSMM301CBWCA.8.12.B01.1.454.light.4.raw

SEQ ID NO: 582927 - DNA, 481 bp, Homo sapiens
  misc_feature: HIJSMM301DFZO8.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatcctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccgaagctgaccgtcctaagtcagacccg

SEQ ID NO: 582928 - DNA, 503 bp, Homo sapiens; identical to SEQ ID NO: 537216
  misc_feature: HIJSMM301CRRSK.3.70.G04.1.454.light.4.raw

SEQ ID NO: 582929 - DNA, 490 bp, Homo sapiens
  misc_feature: HIJSMM301CWK9U.16.68.G02.1.454.light.4.raw
  modified_base (427)..(427): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattntaatttcggtggagggaccaaggtggaggtcaaagaactgtggctgcaccatctgtcttcatt

SEQ ID NO: 582930 - DNA, 517 bp, Homo sapiens
  misc_feature: HIJSMM301C8XIV.48.14.B03.1.454.light.4.raw
agtatacatacacgaccggtgctcgatttagtgtgagtagttccgcggggcgggtgggggcacttctccctctaacactctcccctgttgaagctctttgtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaaggtaaccc

SEQ ID NO: 582931 - DNA, 476 bp, Homo sapiens
  misc_feature: HIJSMM301B2H0B.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtccccacaactcctgatctatgaagttgccacccggctctctggagtgccagatatgttcagtggctgcgggtcaggcacagatctcacactgaaaaacagccgggtggagagtgaccatgttggaacttattactgcatgcaag

SEQ ID NO: 582932 - DNA, 499 bp, Homo sapiens
  misc_feature: HIJSMM301E2M6W.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgtttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgtcccaccct

SEQ ID NO: 582933 - DNA, 484 bp, Homo sapiens; identical to SEQ ID NO: 535400
  misc_feature: HIJSMM301CNQYU.46.26.C04.1.454.light.4.raw

SEQ ID NO: 582934 - DNA, 514 bp, Homo sapiens; identical to SEQ ID NO: 547648
  misc_feature: HIJSMM301BVT4N.16.1.A01.1.454.light.4.raw

SEQ ID NO: 582935 - DNA, 496 bp, Homo sapiens; identical to SEQ ID NO: 535109
  misc_feature: HIJSMM301C8Z83.16.78.H01.1.454.light.4.raw

SEQ ID NO: 582936 - DNA, 510 bp, Homo sapiens
  misc_feature: HIJSMM301D15ID.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccgaaggaccgaaggtaggaagtacaaacgaactagtggctgcaccatctgtcttctactcttcccgcccact

SEQ ID NO: 582937 - DNA, 514 bp, Homo sapiens; identical to SEQ ID NO: 543100
  misc_feature: HIJSMM301C9DQV.8.23.C01.1.454.light.4.raw

SEQ ID NO: 582938 - DNA, 490 bp, Homo sapiens; identical to SEQ ID NO: 542820
  misc_feature: HIJSMM301CQGD9.11.12.B01.1.454.light.4.raw

SEQ ID NO: 582939 - DNA, 495 bp, Homo sapiens
  misc_feature: HIJSMM301BGMD3.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccactctgtt

SEQ ID NO: 582940 - DNA, 494 bp, Homo sapiens
  misc_feature: HIJSMM301D289P.52.81.H04.1.454.light.4.raw
cgcagtacgacacgaccggtgctcgatttagtagtgtagattcgcgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactcgtca

SEQ ID NO: 582941 - DNA, 487 bp, Homo sapiens; identical to SEQ ID NO: 543396
  misc_feature: HIJSMM301CM1KD.46.26.C04.1.454.light.4.raw

SEQ ID NO: 582942 - DNA, 486 bp, Homo sapiens
  misc_feature: HIJSMM301C4292.5.28.C06.1.454.light.4.raw
  modified_base (358)..(358): a, c, t, g, unknown or other
atcagacacgcacgaccggtgctcgatttagagctcacgtattgggtttggggagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttnaccatcagcagcctgcaacctgaagatattgtcaacaatattactgtcaacaagtatgatagtctggccgcctcggtcggagggaccgaaggtaggaggagtcgaacgaactagtggcgtgcacaact

SEQ ID NO: 582943 - DNA, 444 bp, Homo sapiens; identical to SEQ ID NO: 535027
  misc_feature: HIJSMM301CWEH8.8.73.G07.1.454.light.4.raw

SEQ ID NO: 582944 - DNA, 505 bp, Homo sapiens
  misc_feature: HIJSMM301D4BKF.53.71.G05.1.454.light.4.raw
  modified_base (406)..(406): a, c, t, g, unknown or other
cgcgtatacacacgaccggtgctcgatttagtgtcgtcgcaagagagagggggctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattacngtcaggtgtgggattttaatagtgatcattgggtgttcggcggagggaccaagctgaccgtcctaggtcagccaaggctgccccctcggtcactctgtt

SEQ ID NO: 582945 - DNA, 521 bp, Homo sapiens; identical to SEQ ID NO: 539470
  misc_feature: HIJSMM301CRAY8.27.23.C01.1.454.light.4.raw

SEQ ID NO: 582946 - DNA, 497 bp, Homo sapiens; identical to SEQ ID NO: 536371
  misc_feature: HIJSMM301BHPSY.16.78.H01.1.454.light.4.raw

SEQ ID NO: 582947 - DNA, 494 bp, Homo sapiens; identical to SEQ ID NO: 534992
  misc_feature: HIJSMM301DZ5Q8.9.1.A01.1.454.light.4.raw

SEQ ID NO: 582948 - DNA, 500 bp, Homo sapiens; identical to SEQ ID NO: 577922
  misc_feature: HIJSMM301EJ75O.18.59.F04.1.454.light.4.raw

SEQ ID NO: 582949 - DNA, 479 bp, Homo sapiens; identical to SEQ ID NO: 535665
  misc_feature: HIJSMM301EBDV3.12.10.A10.1.454.light.4.raw

SEQ ID NO: 582950 - DNA, 486 bp, Homo sapiens; identical to SEQ ID NO: 537617
  misc_feature: HIJSMM301BHCEL.10.53.E09.1.454.light.4.raw

SEQ ID NO: 582951 - DNA, 484 bp, Homo sapiens; identical to SEQ ID NO: 535400
  misc_feature: HIJSMM301CBZ8T.46.26.C04.1.454.light.4.raw

SEQ ID NO: 582952 - DNA, 496 bp, Homo sapiens
  misc_feature: HIJSMM301ESL9D.22.86.H09.1.454.light.4.raw
acatacgcgtcacgaccggtgctcgatttagtgctatagacttgggtttgggggctttgcctgggctctgctcctccccagcctcctcactcagggcacaggatcctgggctcagtctgccctgactcagcctcgctcagtgtccgggtctcctggacagtcagtcaccatctcctacactgggaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtccaggtcagcccaaggcctgccccctcggtcactctgttcccgccctcctcacgcgta

SEQ ID NO: 582953 - DNA, 444 bp, Homo sapiens; identical to SEQ ID NO: 550016
  misc_feature: HIJSMM301A405O.14.76.G10.1.454.light.4.raw

SEQ ID NO: 582954 - DNA, 492 bp, Homo sapiens
  misc_feature: HIJSMM301DRRB0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgtagtctattactgtcagcagtatggtcacgtcccaagtaacttttggccaggggaccaagctggagatcaaacgaactgtggctgcaccatctgtt

SEQ ID NO: 582955 - DNA, 495 bp, Homo sapiens; identical to SEQ ID NO: 535596
  misc_feature: HIJSMM301CDOKV.10.79.H02.1.454.light.4.raw

SEQ ID NO: 582956 - DNA, 509 bp, Homo sapiens
  misc_feature: HIJSMM301AYWDG.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggccctgctgctgctgggtctggccatggtcgcccatggcctgctgcgcccaatcggttgcaccgcaaagcggggacccagaccctggagcctcagttggaagcagccgatccagcctgcggagcctgtgggcaggtcagcccaaggccaaccccactgtcactc

SEQ ID NO: 582957 - DNA, 515 bp, Homo sapiens
  misc_feature: HIJSMM301EDS79.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgacccatcagcgcggtcgaagccggagatgaggccgactattactgtcaggtgtgggacagtaatagtgatcccgagcaggttttcggcggtgggaccaagctgaccgtcctaagtcagcccaaggctgccccctcggtcactctgttccccg

SEQ ID NO: 582958 - DNA, 480 bp, Homo sapiens
  misc_feature: HIJSMM301C8FTT.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagctccctggtcatcgctgggctccaggctgacgatgaggctgattattattgccagtcctatgacaacacctgcgtggtttttggctgttcggcggcgggacc

SEQ ID NO: 582959 - DNA, 509 bp, Homo sapiens; identical to SEQ ID NO: 539359
  misc_feature: HIJSMM301C8VSX.47.85.H08.1.454.light.4.raw

SEQ ID NO: 582960 - DNA, 485 bp, Homo sapiens; identical to SEQ ID NO: 536210
  misc_feature: HIJSMM301BXQ3P.43.54.E10.1.454.light.4.raw

SEQ ID NO: 582961 - DNA, 490 bp, Homo sapiens
  misc_feature: HIJSMM301CYMQY.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaactccttacacttttggccaggggaccaagctggagatcaaacgaactgt

SEQ ID NO: 582962 - DNA, 505 bp, Homo sapiens
  misc_feature: HIJSMM301CRO09.19.67.G01.1.454.light.4.raw
tactctcgtgcacgaccggtgctcgatttagagtatacatattgggtttgggggagctacaacaggcaggcaggggcagcaagatggtgttgcagacccaggtcttcatttctctgttgctctggatctctggttcctgcggggacatcgtgatgacccagtacccagactcactggctgtgtctctgggcgagacggccacaatcaactgcaggtccagccagaacattttctccacctccaagaacaaaaacttcttagcctggtaccaacagagaccaggacagcctcctaagttgctcatttactgggcttctacgcgcgaattcggggtccctgaccgattccggggcagcgggtctgggacagatttcactctcaccatcagcagcctgcaggctgaagatgtggcagtttatactgtcagctaattatttttcttatcctccgtggacgttcggccaagggaccagggtgaaatcagacgaacgtgtggctgcaccat

SEQ ID NO: 582963 - DNA, 500 bp, Homo sapiens
  misc_feature: HIJSMM301A8R4Q.22.86.H09.1.454.light.4.raw
  modified_base (484)..(484): a, c, t, g, unknown or other
acatacgcgtcacgaccggtgctcgatttagtgctatagacttggggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtccagcccaaggctgccccctcggtcactcngttcccgccctcctcc

SEQ ID NO: 582964 - DNA, 500 bp, Homo sapiens
  misc_feature: HIJSMM301EM7MF.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattatactgcagctcatatagaagtggcagcactctcgtattcggcggtgggaccaagctgaccgtcctaggtcagcccaaggctgccccccg

SEQ ID NO: 582965 - DNA, 493 bp, Homo sapiens
  misc_feature: HIJSMM301EQLTL.51.87.H10.1.454.light.4.raw
cgatcgtatacacgaccggtgctcgatttagcagtactgcgttgggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtcactc

SEQ ID NO: 582966 - DNA, 501 bp, Homo sapiens
  misc_feature: HIJSMM301DEQ3R.48.83.H06.1.454.light.4.raw
agtatacatacacgaccggtgctcgatttagatcacgtgcgtcgcggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagcccaaggctgcccctcggtcactctgttcccacctcct

SEQ ID NO: 582967 - DNA, 487 bp, Homo sapiens; identical to SEQ ID NO: 557252
  misc_feature: HIJSMM301AIV8Y.46.35.D02.1.454.light.4.raw

SEQ ID NO: 582968 - DNA, 491 bp, Homo sapiens; identical to SEQ ID NO: 536211
  misc_feature: HIJSMM301BS814.16.53.E09.1.454.light.4.raw

SEQ ID NO: 582969 - DNA, 475 bp, Homo sapiens; identical to SEQ ID NO: 549567
  misc_feature: HIJSMM301ATK9X.3.82.H05.1.454.light.4.raw

SEQ ID NO: 582970 - DNA, 512 bp, Homo sapiens
  misc_feature: HIJSMM301ASBAJ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggtttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctggtcactctgttcccaccctcctcgagtagtaca

SEQ ID NO: 582971 - DNA, 488 bp, Homo sapiens
  misc_feature: HIJSMM301D2QY6.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcgaggcgaacg

SEQ ID NO: 582972 - DNA, 494 bp, Homo sapiens; identical to SEQ ID NO: 545671
  misc_feature: HIJSMM301DRQ13.9.1.A01.1.454.light.4.raw

SEQ ID NO: 582973 - DNA, 483 bp, Homo sapiens
  misc_feature: HIJSMM301C54TZ.48.19.B08.1.454.light.4.raw
  modified_base (434)..(434): a, c, t, g, unknown or other
  modified_base (443)..(443): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctcctgaccatctctgggctccaggctgaggatgaggctgattattactgctgctcatatgcaggcagctanacttgggtnttcggcggagggacccaagctgacccgtcctaggtccacg

SEQ ID NO: 582974 - DNA, 500 bp, Homo sapiens; identical to SEQ ID NO: 581977
  misc_feature: HIJSMM301C4S6I.19.78.H01.1.454.light.4.raw

SEQ ID NO: 582975 - DNA, 505 bp, Homo sapiens
  misc_feature: HIJSMM301DBS87.18.59.F04.1.454.light.4.raw
tacgagtatgcacgaccggtgctcgatttagtacacacacttaggggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccca

SEQ ID NO: 582976 - DNA, 496 bp, Homo sapiens; identical to SEQ ID NO: 561254
  misc_feature: HIJSMM301DPGUY.41.18.B07.1.454.light.4.raw

SEQ ID NO: 582977 - DNA, 496 bp, Homo sapiens; identical to SEQ ID NO: 535109
  misc_feature: HIJSMM301DTM7Y.16.78.H01.1.454.light.4.raw

SEQ ID NO: 582978 - DNA, 490 bp, Homo sapiens; identical to SEQ ID NO: 535234
  misc_feature: HIJSMM301EE5QY.17.21.B10.1.454.light.4.raw

SEQ ID NO: 582979 - DNA, 483 bp, Homo sapiens
  misc_feature: HIJSMM301CFZHF.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcgccagggaccaagtggaatcaacgaactgtggctgcaccat

SEQ ID NO: 582980 - DNA, 484 bp, Homo sapiens; identical to SEQ ID NO: 540581
  misc_feature: HIJSMM301B7LKK.3.88.H11.1.454.light.4.raw

SEQ ID NO: 582981 - DNA, 489 bp, Homo sapiens; identical to SEQ ID NO: 535139
  misc_feature: HIJSMM301DNQPX.14.55.E11.1.454.light.4.raw

SEQ ID NO: 582982 - DNA, 494 bp, Homo sapiens
  misc_feature: HIJSMM301D0EM3.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaaggcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagcccaagg

SEQ ID NO: 582983 - DNA, 490 bp, Homo sapiens; identical to SEQ ID NO: 535936
  misc_feature: HIJSMM301DBWBW.16.68.G02.1.454.light.4.raw

SEQ ID NO: 582984 - DNA, 486 bp, Homo sapiens
  misc_feature: HIJSMM301CVW9N.43.50.E06.1.454.light.4.raw
tgtgagtagtcacgaccggtgctcgatttagatctactgacaacacacaagggggcaggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgccgggcaagtcagagcattaggacctatctaaattggtatcagcagaaccagggaaagtccctgaggtcctcatcctatggtgcatccagtttgccaagtggggtcccagcaaggttcagtggcagtggatctgggacagatttcacttctcaccatcagcagtctacaacctgaagattttgcaacttactactgtcaacagagtttcagtacccctctgacgttcggccaagggaccaaggtggaataaacgaactagtggctgcta

SEQ ID NO: 582985 - DNA, 488 bp, Homo sapiens
  misc_feature: HIJSMM301DIHWP.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaattttattactgtcagcaatataatacctggcctccgctcactttcggcggagggaccaaggttgagatcaaacgaactgtggctgcacc

SEQ ID NO: 582986 - DNA, 531 bp, Homo sapiens
  misc_feature: HIJSMM301BA9KB.40.27.C05.1.454.light.4.raw
tctagcgactcacgaccggtgctcgatttagacgcgatcgaagggtttgggggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctcgccccctcggtccactctcgttccccaccctcctcagtccgtc

SEQ ID NO: 582987 - DNA, 521 bp, Homo sapiens; identical to SEQ ID NO: 539470
  misc_feature: HIJSMM301EDVF2.27.23.C01.1.454.light.4.raw

SEQ ID NO: 582988 - DNA, 476 bp, Homo sapiens
  misc_feature: HIJSMM301B6YYO.13.6.A06.1.454.light.4.raw
tcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgatttatactgctgctcatatgcaggcagctacactgtactattcggcggagggaccaagctgaccgtctaggtcagcccaaggctgcccctggtcactctcg

SEQ ID NO: 582989 - DNA, 505 bp, Homo sapiens; identical to SEQ ID NO: 536254
  misc_feature: HIJSMM301CDKZ0.7.71.G05.1.454.light.4.raw

SEQ ID NO: 582990 - DNA, 492 bp, Homo sapiens; identical to SEQ ID NO: 547144
  misc_feature: HIJSMM301DM0ZE.16.53.E09.1.454.light.4.raw

SEQ ID NO: 582991 - DNA, 483 bp, Homo sapiens; identical to SEQ ID NO: 535413
  misc_feature: HIJSMM301A09OW.26.78.H01.1.454.light.4.raw

SEQ ID NO: 582992 - DNA, 485 bp, Homo sapiens; identical to SEQ ID NO: 536799
  misc_feature: HIJSMM301DBRSM.19.71.G05.1.454.light.4.raw

SEQ ID NO: 582993 - DNA, 500 bp, Homo sapiens
  misc_feature: HIJSMM301AS32X.40.11.A11.1.454.light.4.raw
tctagcgactcacgaccggtgctcgatttagctacgactgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactagtggctgcaccatctgtt

SEQ ID NO: 582994 - DNA, 513 bp, Homo sapiens
  misc_feature: HIJSMM301D2YVV.17.33.C11.1.454.light.4.raw
  modified_base (425)..(425): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggnggtgctgtgctattcggcggagggaccaagctgaccgtcttaagtcagcccaaggctgccccctcggtcactctgttcccgccctcct

SEQ ID NO: 582995 - DNA, 482 bp, Homo sapiens
  misc_feature: HIJSMM301A2DVX.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgtgacttattattgccaacagtataagagttattcaactttcggccctgggaccaatgtggatatcaaacgaactgtggctgcaccatctgtctt

SEQ ID NO: 582996 - DNA, 496 bp, Homo sapiens; identical to SEQ ID NO: 540594
  misc_feature: HIJSMM301ANOWN.4.59.F04.1.454.light.4.raw

SEQ ID NO: 582997 - DNA, 518 bp, Homo sapiens
  misc_feature: HIJSMM301ALZ0E.16.66.F11.1.454.light.4.raw
tgtactactccacgaccggtgctcgatttagtcacgcgagaagggtgagaagtagtggagcatccccactatgggcctgggctaccgactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccaggggtggtgttcggcggagggaccaagctggccgtcctaggtcagcccaaggctgccccctcggtcactctgttcccaccctcctcgagtagtaca

SEQ ID NO: 582998 - DNA, 491 bp, Homo sapiens; identical to SEQ ID NO: 544714
  misc_feature: HIJSMM301D0KHX.18.11.A11.1.454.light.4.raw

SEQ ID NO: 582999 - DNA, 518 bp, Homo sapiens; identical to SEQ ID NO: 536231
  misc_feature: HIJSMM301B4MNS.22.30.C08.1.454.light.4.raw

SEQ ID NO: 583000 - DNA, 507 bp, Homo sapiens
  misc_feature: HIJSMM301BDOZQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactacgtggctgcaccactctgtcttcatcttccccg

SEQ ID NO: 583001 - DNA, 495 bp, Homo sapiens
  misc_feature: HIJSMM301CLIQL.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaaaacctacttgagttggtttcagcagaggccaggccaatctccaaggcgcctaaatttataaggtttctaggcgggactctggggtcccagacagattcagcggcagtgggtcaggcgctgatttcacactgagaatcagcagggtggaggctgaagatgtcggggtttattactgcatgcagggtacagtgtggcttcgctcgcattcggcgaagggaccaaggtggagatcaaacgaactagtgg

SEQ ID NO: 583002 - DNA, 504 bp, Homo sapiens
  misc_feature: HIJSMM301AN7SA.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccac

SEQ ID NO: 583003 - DNA, 494 bp, Homo sapiens; identical to SEQ ID NO: 537229
  misc_feature: HIJSMM301EZ3TH.52.42.D09.1.454.light.4.raw

SEQ ID NO: 583004 - DNA, 499 bp, Homo sapiens
  misc_feature: HIJSMM301C2II3.43.87.H10.1.454.light.4.raw
tgtgagtagtcacgaccggtgctcgatttagcagtactgcgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccc

SEQ ID NO: 583005 - DNA, 416 bp, Homo sapiens; identical to SEQ ID NO: 545902
  misc_feature: HIJSMM301ETZO9.18.78.H01.1.454.light.4.raw

SEQ ID NO: 583006 - DNA, 521 bp, Homo sapiens
  misc_feature: HIJSMM301B60CR.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgttcggtccacgggaccgacaacgtagaaagtagagacggaaactgtggcgtgtcgaccaactctcgtcttcctactcttcctcccg

SEQ ID NO: 583007 - DNA, 496 bp, Homo sapiens
  misc_feature: HIJSMM301C6XZX.19.71.G05.1.454.light.4.raw
  modified_base (477)..(477): a, c, t, g, unknown or other
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcgccaagggaccaaggtggagtatnagacgaaactgtggctgca

SEQ ID NO: 583008 - DNA, 493 bp, Homo sapiens; identical to SEQ ID NO: 538304
  misc_feature: HIJSMM301DFTF0.26.72.G06.1.454.light.4.raw

SEQ ID NO: 583009 - DNA, 474 bp, Homo sapiens; identical to SEQ ID NO: 535264
  misc_feature: HIJSMM301AU08M.13.76.G10.1.454.light.4.raw

SEQ ID NO: 583010 - DNA, 494 bp, Homo sapiens; identical to SEQ ID NO: 536974
  misc_feature: HIJSMM301CQIFI.16.86.H09.1.454.light.4.raw

SEQ ID NO: 583011 - DNA, 506 bp, Homo sapiens; identical to SEQ ID NO: 563474
  misc_feature: HIJSMM301ARU1M.10.27.C05.1.454.light.4.raw

SEQ ID NO: 583012 - DNA, 486 bp, Homo sapiens; identical to SEQ ID NO: 535043
  misc_feature: HIJSMM301ALOMD.46.35.D02.1.454.light.4.raw

SEQ ID NO: 583013 - DNA, 502 bp, Homo sapiens
  misc_feature: HIJSMM301AS5DO.49.58.F03.1.454.light.4.raw
  modified_base (438)..(438): a, c, t, g, unknown or other
agtcgagagacacgaccggtgctcgatttagtctgatcgagaagggaaagggggctgtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgataacactattgtctccgngtttttcggtcggtagggaccaggctgaccgtcctgggtcagccaaggctgcccctcggtcact

SEQ ID NO: 583014 - DNA, 490 bp, Homo sapiens; identical to SEQ ID NO: 577623
  misc_feature: HIJSMM301DBSO7.49.42.D09.1.454.light.4.raw

SEQ ID NO: 583015 - DNA, 491 bp, Homo sapiens; identical to SEQ ID NO: 536211
  misc_feature: HIJSMM301C3UEB.16.53.E09.1.454.light.4.raw

SEQ ID NO: 583016 - DNA, 454 bp, Homo sapiens; identical to SEQ ID NO: 536943
  misc_feature: HIJSMM301EOCK3.19.86.H09.1.454.light.4.raw

SEQ ID NO: 583017 - DNA, 516 bp, Homo sapiens
  misc_feature: HIJSMM301CPORJ.17.28.C06.1.454.light.4.raw
cgtagactagcacgaccggtgctcgatttagagctcacgtattgggtttggggggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgatcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgccccctcggtcactctgttcccgccct

SEQ ID NO: 583018 - DNA, 486 bp, Homo sapiens
  misc_feature: HIJSMM301DLCQP.12.31.C09.1.454.light.4.raw
  modified_base (393)..(393): a, c, t, g, unknown or other
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaagcaggcaaagtcccaaagctcctgatttatgctgccaccagtctgcaaggtggttcccgtcaaggttcactggccgtggatcagggacagaatttactctcaccatcagtagtctacagcctgaagntattgctacttattactgtcagcagagttaccgcgctcccatcactttcggccaagggacacgaccgcagattggacgaactgtggctgcacc

SEQ ID NO: 583019 - DNA, 498 bp, Homo sapiens
  misc_feature: HIJSMM301B82FJ.12.28.C06.1.454.light.4.raw
  modified_base (456)..(456): a, c, t, g, unknown or other
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaatggtgtcccatcaaggttcagtggcagtggatctgggacacaattcactctcaccatcgctgatctgcagcctgaagattttgcaacttactactgtcaacagagtttcagtgtcccccggacgtcgcaggacgacacgagaatanagacgaacagtggctgcaccactctgtcttctatcttcccgt

SEQ ID NO: 583020 - DNA, 493 bp, Homo sapiens; identical to SEQ ID NO: 536246
  misc_feature: HIJSMM301ANL0H.49.66.F11.1.454.light.4.raw

SEQ ID NO: 583021 - DNA, 511 bp, Homo sapiens
  misc_feature: HIJSMM301AKFK0.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaatttttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatgggatagcagcctgagtactgtgataatcggcggagggaccaagctgaccgtcctaggtcagcccaaggctgccccctcggtcactctgttcccg

SEQ ID NO: 583022 - DNA, 516 bp, Homo sapiens
  misc_feature: HIJSMM301DSWYB.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactgtggctgcaccatctgtcttcatcttccccg

SEQ ID NO: 583023 - DNA, 506 bp, Homo sapiens
  misc_feature: HIJSMM301E1ZRD.26.23.C01.1.454.light.4.raw
  modified_base (434)..(434): a, c, t, g, unknown or other
  modified_base (499)..(499): a, c, t, g, unknown or other
agactatactcacgaccggtgctcgatttagtacacgtgattagggattgggggaatcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccacaatatgatattattattcctacncgtcggcgtacggaccggaaggacggaaggtacgtaagacgaacgacgtaggtgtcgcgccaacnctcttcg

SEQ ID NO: 583024 - DNA, 474 bp, Homo sapiens
  misc_feature: HIJSMM301BH29I.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcggaccattagcacctttttaaattggtatcaacagagcccaggaaaagacccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 583025 - DNA, 484 bp, Homo sapiens; identical to SEQ ID NO: 536162
  misc_feature: HIJSMM301D778I.13.59.F04.1.454.light.4.raw

SEQ ID NO: 583026 - DNA, 484 bp, Homo sapiens; identical to SEQ ID NO: 537878
  misc_feature: HIJSMM301C41X0.17.34.D01.1.454.light.4.raw

SEQ ID NO: 583027 - DNA, 507 bp, Homo sapiens
  misc_feature: HIJSMM301ATQSN.5.24.C02.1.454.light.4.raw
  modified_base (497)..(497): a, c, t, g, unknown or other
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggccaagctgaccgtcctaggtcagcccaaggcncgtccccccg

SEQ ID NO: 583028 - DNA, 489 bp, Homo sapiens; identical to SEQ ID NO: 535139
  misc_feature: HIJSMM301D2OJI.14.55.E11.1.454.light.4.raw

SEQ ID NO: 583029 - DNA, 483 bp, Homo sapiens
  misc_feature: HIJSMM301D94B0.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgtttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccaggggtggagatcagacgaa

SEQ ID NO: 583030 - DNA, 497 bp, Homo sapiens
  misc_feature: HIJSMM301BHGVX.43.48.E04.1.454.light.4.raw
tgtgagtagtcacgaccggtgctcgatttagagagcgtcacagagagaaggggcgcacagagagaagggggagaagtagagggatccagaactctgggtgtctcaccatggcctggatccctctacttctccccctcctcactctctgcacagactctgaggcctcctatgtgctgacacagccaacctcggtgtcagtgtccccaggacagacggccaggatcacctgttccggagatgcattggcaaaggaatatgcttactggtaccagcaaaagacaggccaggcccctgttttggtgatatttaaagacaatgagagaccctcagggatcccagagcgattctctggctccagctcagggacaagagtcacgttgaccatccgtggagtccagccagaggacgaggctgaatattcctgtcaatcagtagacagtagtggttcttatgtattcggcactgggaccaaggtcaatgtcctaggtcagcccaac

SEQ ID NO: 583031 - DNA, 467 bp, Homo sapiens
  misc_feature: HIJSMM301BN7GZ.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccacctgcaaagtggagtcccatccagattcagcgtcagtgaatctgggacagagttcactctcaccatcagcagcctgcagcctgaagattttgcaacttactattgtcaacaggctgacagtctccgctcactttcggcggagggaccaaggtggagatcaaacgaa

SEQ ID NO: 583032 - DNA, 460 bp, Homo sapiens; identical to SEQ ID NO: 536053
  misc_feature: HIJSMM301BOWDG.22.28.C06.1.454.light.4.raw

SEQ ID NO: 583033 - DNA, 486 bp, Homo sapiens; identical to SEQ ID NO: 535043
  misc_feature: HIJSMM301B0QP9.46.35.D02.1.454.light.4.raw

SEQ ID NO: 583034 - DNA, 508 bp, Homo sapiens; identical to SEQ ID NO: 536062
  misc_feature: HIJSMM301A6T7Q.11.57.F02.1.454.light.4.raw

SEQ ID NO: 583035 - DNA, 486 bp, Homo sapiens; identical to SEQ ID NO: 544919
  misc_feature: HIJSMM301A32FM.7.85.H08.1.454.light.4.raw

SEQ ID NO: 583036 - DNA, 487 bp, Homo sapiens; identical to SEQ ID NO: 558003
  misc_feature: HIJSMM301EQ7YF.47.70.G04.1.454.light.4.raw

SEQ ID NO: 583037 - DNA, 496 bp, Homo sapiens
  misc_feature: HIJSMM301D3Y2K.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggaggaccaaggtgaccgtcctaggtcagcccaaggctg

SEQ ID NO: 583038 - DNA, 512 bp, Homo sapiens
  misc_feature: HIJSMM301EAGDS.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccgggacgtcggtccgacgggaccgacacgtagaaatagagacgaactagtggcgtgcaccactctcgtcttctatcttcccgt

SEQ ID NO: 583039 - DNA, 521 bp, Homo sapiens; identical to SEQ ID NO: 538715
  misc_feature: HIJSMM301AVZGP.27.23.C01.1.454.light.4.raw

SEQ ID NO: 583040 - DNA, 497 bp, Homo sapiens
  misc_feature: HIJSMM301C0BR0.48.31.C09.1.454.light.4.raw
agtatacatacacgaccggtgctcgatttagacgtctcatcaaggaaggaagggggagtcagtctcagtcaggacacagcatggacatgagggtccccgctcagctcctggggctcctgctactctggctccgaggtgccagatgtgacatccagctgacccagtctccatcctccctgtctgcttctgtgggagacagagtcaccatcacttgccgggcaagtcagaacattggcgattacttcaattggtatcagcagaaaccagggaaagcccctaaactcttaatctacactgcagcccggttgcaaagtggagtcccatcaaggttcagtggcaatggatccgggacagattttcgactcaccatcagcagtctacaacctgaagattttgcaacctacttctgtcaccaggcttacaattcccctccgacgttcggccaagggaccaaggtggaagtcagacgaactgtggctgcaccatctgtcttcatt

SEQ ID NO: 583041 - DNA, 491 bp, Homo sapiens; identical to SEQ ID NO: 540281
  misc_feature: HIJSMM301C123Q.19.71.G05.1.454.light.4.raw

SEQ ID NO: 583042 - DNA, 508 bp, Homo sapiens
  misc_feature: HIJSMM301AFG5H.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctcgggtcagcccaaggctgcccctccggtcactctcgttcccaccctcctcctacgtcgtat

SEQ ID NO: 583043 - DNA, 486 bp, Homo sapiens
  misc_feature: HIJSMM301END5U.10.59.F04.1.454.light.4.raw
catagtagtgcacgaccggtgctcgatttagtacacacacttaggggattggggggggtcgtcaggagggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcgggggtccctgatcgcttctctggctccaagtctggcaacacggcctccctgaccatctctggcctccagcctgaggatgaggctgattattactgttgctcatatgcaggcggtaccgcttgggtgttcggcggagggaccaagctgaccgtccaggtcag

SEQ ID NO: 583044 - DNA, 494 bp, Homo sapiens; identical to SEQ ID NO: 534992
  misc_feature: HIJSMM301DGAIF.9.1.A01.1.454.light.4.raw

SEQ ID NO: 583045 - DNA, 460 bp, Homo sapiens; identical to SEQ ID NO: 537107
  misc_feature: HIJSMM301CEEMU.22.28.C06.1.454.light.4.raw

SEQ ID NO: 583046 - DNA, 444 bp, Homo sapiens; identical to SEQ ID NO: 571542
  misc_feature: HIJSMM301ELZEZ.47.85.H08.1.454.light.4.raw

SEQ ID NO: 583047 - DNA, 505 bp, Homo sapiens
  misc_feature: HIJSMM301BKNQ2.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatggcagtggcgtttgggtgttcggcggagggaccaagctgaccgtcg

SEQ ID NO: 583048 - DNA, 496 bp, Homo sapiens; identical to SEQ ID NO: 556037
  misc_feature: HIJSMM301B4IEB.41.38.D05.1.454.light.4.raw

SEQ ID NO: 583049 - DNA, 502 bp, Homo sapiens
  misc_feature: HIJSMM301EQP1U.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccctac

SEQ ID NO: 583050 - DNA, 486 bp, Homo sapiens
  misc_feature: HIJSMM301D5AJ8.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtacccgtacacttttggccagggaccaaactggacatcaaacgaactgtggctgcaccatctgtt

SEQ ID NO: 583051 - DNA, 502 bp, Homo sapiens
  misc_feature: HIJSMM301AZHTR.9.71.G05.1.454.light.4.raw
  modified_base (448)..(448): a, c, t, g, unknown or other
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagntattcggcggagggaccaggctgaccgtcctgagtcagcccaaggctgcccccc

SEQ ID NO: 583052 - DNA, 484 bp, Homo sapiens; identical to SEQ ID NO: 535297
  misc_feature: HIJSMM301EXCUQ.10.35.D02.1.454.light.4.raw

SEQ ID NO: 583053 - DNA, 514 bp, Homo sapiens; identical to SEQ ID NO: 541418
  misc_feature: HIJSMM301CGZT6.17.33.C11.1.454.light.4.raw

SEQ ID NO: 583054 - DNA, 494 bp, Homo sapiens; identical to SEQ ID NO: 577002
  misc_feature: HIJSMM301EEDGE.40.71.G05.1.454.light.4.raw

SEQ ID NO: 583055 - DNA, 466 bp, Homo sapiens
  misc_feature: HIJSMM301AHEKC.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtcaaagaatagcgctgccccgctcagtttcggcggagggaccaaggtggaggatac

SEQ ID NO: 583056 - DNA, 511 bp, Homo sapiens
  misc_feature: HIJSMM301AKZL4.43.19.B08.1.454.light.4.raw
tgtgagtagtcacgaccggtgctcgatttagtgagtcagtaaggggctgtctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagttgaccgtcctaagtcagcccaaggctgccccctcggtcactctgttcccgccct

SEQ ID NO: 583057 - DNA, 447 bp, Homo sapiens; identical to SEQ ID NO: 535201
  misc_feature: HIJSMM301DHYOT.18.9.A09.1.454.light.4.raw

SEQ ID NO: 583058 - DNA, 494 bp, Homo sapiens; identical to SEQ ID NO: 577002
  misc_feature: HIJSMM301ADLJ4.40.71.G05.1.454.light.4.raw

SEQ ID NO: 583059 - DNA, 506 bp, Homo sapiens; identical to SEQ ID NO: 539705
  misc_feature: HIJSMM301AL533.40.67.G01.1.454.light.4.raw

SEQ ID NO: 583060 - DNA, 488 bp, Homo sapiens
  misc_feature: HIJSMM301A4B5W.46.35.D02.1.454.light.4.raw
actagcagtacacgaccggtgctcgatttagcacacgatagttgggtttgggggagctgctcagttaggacccaggagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaaacgaactgtggctgcaccat

SEQ ID NO: 583061 - DNA, 505 bp, Homo sapiens; identical to SEQ ID NO: 535503
  misc_feature: HIJSMM301DKUV8.8.28.C06.1.454.light.4.raw

SEQ ID NO: 583062 - DNA, 494 bp, Homo sapiens; identical to SEQ ID NO: 535276
  misc_feature: HIJSMM301AGYP3.16.6.A06.1.454.light.4.raw

SEQ ID NO: 583063 - DNA, 504 bp, Homo sapiens; identical to SEQ ID NO: 567466
  misc_feature: HIJSMM301APBRA.10.82.H05.1.454.light.4.raw

SEQ ID NO: 583064 - DNA, 516 bp, Homo sapiens
  misc_feature: HIJSMM301CII2N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtgtcgaggaccgaacggaggaagtacgaaacgaaacgtaacgtaggacgtggcaccactactgtcttcctatctttccccg

SEQ ID NO: 583065 - DNA, 496 bp, Homo sapiens; identical to SEQ ID NO: 535109
  misc_feature: HIJSMM301DSU8I.16.78.H01.1.454.light.4.raw

SEQ ID NO: 583066 - DNA, 510 bp, Homo sapiens; identical to SEQ ID NO: 535474
  misc_feature: HIJSMM301AZK53.17.33.C11.1.454.light.4.raw

SEQ ID NO: 583067 - DNA, 486 bp, Homo sapiens
  misc_feature: HIJSMM301DN3E3.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaacaatattattatacttcgtggacgttcggtccaagggaccaaggtggatatcagacgaa

SEQ ID NO: 583068 - DNA, 523 bp, Homo sapiens
  misc_feature: HIJSMM301D0VDS.17.33.C11.1.454.light.4.raw
cgtagactagcacgaccggtgctcgatttagagtgagctcgttgggtttgggggggcgccaggggtcccttccaatatcagcaccatggcctggactcctctctttctgttcctcctcacttgctgcccagggtccaattctcagactgtggtgactcaggagccctcactgactgtgtccccagggagggacagtcactctcacctgtgcttccaacactggagcagtcaccagtgcttactattccaaactggttccagcagaaacctggacaaagcacccagggcactcactttaatagtacaaacaacaaacactcctggacccctgccccgattcgttcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctcct

SEQ ID NO: 583069 - DNA, 491 bp, Homo sapiens; identical to SEQ ID NO: 542796
  misc_feature: HIJSMM301BKA3X.19.57.F02.1.454.light.4.raw

SEQ ID NO: 583070 - DNA, 511 bp, Homo sapiens
  misc_feature: HIJSMM301BFGC9.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggcccgtcgggaccgaaagtaggagtatacaaacgaactagtggctgcaccatctgtt

SEQ ID NO: 583071 - DNA, 503 bp, Homo sapiens
  misc_feature: HIJSMM301BT0XO.43.57.F02.1.454.light.4.raw
tgtgagtagtcacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgaggtcaataagcggccgtcaggggtccctgatcgcttctctggctccaagtctggcaacacggccaccctgaccgtctctgggctccaggctgaggatgaggctcattattactgcagctcatatacaggcaacaagaatttggtgttcggcggagggaccgagctgaccgtcctaggtcagcccaaggctgcccccc

SEQ ID NO: 583072 - DNA, 446 bp, Homo sapiens
  misc_feature: HIJSMM301BZNOD.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccacctcctccatactcgta

SEQ ID NO: 583073 - DNA, 444 bp, Homo sapiens; identical to SEQ ID NO: 534993
  misc_feature: HIJSMM301CKQSF.5.9.A09.1.454.light.4.raw

SEQ ID NO: 583074 - DNA, 484 bp, Homo sapiens
  misc_feature: HIJSMM301AGL9C.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctacagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtggctgcacc

SEQ ID NO: 583075 - DNA, 497 bp, Homo sapiens
  misc_feature: HIJSMM301AK9RX.16.12.B01.1.454.light.4.raw
tgtactactccacgaccggtgctcgatttagtagtgtagattccgcggggctgggcctcaggaagcagcatcggaggtgcctcagccatggcatggatccctctcttcctcggcgtccttgcttactgcacagtatcggtggcctcctatcagttgactcagccaccctcagtgtccgtgtccccaggacagacggccagcatcatctgctctggagataacttgggggataaatatactttctggtatcagcagaaggccggccagtcccctgtattggtcatctttcaagataccgagcggccctcagagatccctgagcgattctctggctccaactctgggaacacagccactctgaccatcagcggggcccagactatggatgaggctgactattactgtcaggcgtgggacagcaattctgtgattttcggcggagggaccaagttgaccgtcctaggtcagcccaaggctgccccctcggtcactcttcg

SEQ ID NO: 583076 - DNA, 486 bp, Homo sapiens; identical to SEQ ID NO: 535043
  misc_feature: HIJSMM301DI6OM.46.35.D02.1.454.light.4.raw

SEQ ID NO: 583077 - DNA, 488 bp, Homo sapiens
  misc_feature: HIJSMM301EJ0M7.52.84.H07.1.454.light.4.raw
cgcagtacgacacgaccggtgctcgatttagcagacgtctgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtacgagatcaaacgaactgtggctgcaccatctgtctt

SEQ ID NO: 583078 - DNA, 482 bp, Homo sapiens
  misc_feature: HIJSMM301DRTXP.5.28.C06.1.454.light.4.raw
  modified_base (406)..(406): a, c, t, g, unknown or other
atcagacacgcacgaccggtgctcgatttagagctcacgtattgggtttgggggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaataggggtctcatcaaggttcagtgggagtggatctgggacagaattcactttcaccatcagcagcctgcaacctgaagatattgcaacatattacngtcaacagtatgatagtctggccgccttcggcggagggaccaaggtaggagagtcgaacgaaactcgtggctgcaa

SEQ ID NO: 583079 - DNA, 494 bp, Homo sapiens; identical to SEQ ID NO: 534994
  misc_feature: HIJSMM301AL9UD.27.78.H01.1.454.light.4.raw

SEQ ID NO: 583080 - DNA, 517 bp, Homo sapiens; identical to SEQ ID NO: 557301
  misc_feature: HIJSMM301EOG8T.19.80.H03.1.454.light.4.raw

SEQ ID NO: 583081 - DNA, 488 bp, Homo sapiens; identical to SEQ ID NO: 540342
  misc_feature: HIJSMM301A1T6E.43.33.C11.1.454.light.4.raw

SEQ ID NO: 583082 - DNA, 508 bp, Homo sapiens; identical to SEQ ID NO: 552440
  misc_feature: HIJSMM301CETAH.5.24.C02.1.454.light.4.raw

SEQ ID NO: 583083 - DNA, 498 bp, Homo sapiens
  misc_feature: HIJSMM301BQJI3.40.81.H04.1.454.light.4.raw
tctagcgactcacgaccggtgctcgatttagtagtgtagattcgcgggcacgaccggtgctcgatttagtagtgtagattcgggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactagaaaatcagcagggtggaggcagaagatgttgggtatttattactgcatgcaacctctacaaactgtgtggacggtcggccgaaggacc

SEQ ID NO: 583084 - DNA, 503 bp, Homo sapiens; identical to SEQ ID NO: 545496
  misc_feature: HIJSMM301BX2OI.8.24.C02.1.454.light.4.raw

SEQ ID NO: 583085 - DNA, 488 bp, Homo sapiens
  misc_feature: HIJSMM301CR1Y3.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttatactgtcaacagagttacagtacccccctcactttcggcggagggaccaaggcggagatcagacgaactgtggctgcaccatctgtcttcta

SEQ ID NO: 583086 - DNA, 511 bp, Homo sapiens; identical to SEQ ID NO: 535406
  misc_feature: HIJSMM301AZQF5.43.59.F04.1.454.light.4.raw

SEQ ID NO: 583087 - DNA, 486 bp, Homo sapiens; identical to SEQ ID NO: 581224
  misc_feature: HIJSMM301CK73H.19.71.G05.1.454.light.4.raw

SEQ ID NO: 583088 - DNA, 498 bp, Homo sapiens
  misc_feature: HIJSMM301DCDWY.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttctatcttccccg

SEQ ID NO: 583089 - DNA, 500 bp, Homo sapiens
  misc_feature: HIJSMM301C1WN5.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctggctccaggctgaagacgaggctgattattactgcagctcatatacaaggcagcagcactcaggttttcggcggagggaccaagctgaccgtccctaggtcctagcccaaggctgccccctcggt

SEQ ID NO: 583090 - DNA, 495 bp, Homo sapiens
  misc_feature: HIJSMM301DXQRM.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttactacttttggccaggggaccaagctggagatacaaacgaactgtgg

SEQ ID NO: 583091 - DNA, 515 bp, Homo sapiens
  misc_feature: HIJSMM301CIH7P.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggcctgccccctcggtcactctgttcccgccctcctcgagtagtaca

SEQ ID NO: 583092 - DNA, 485 bp, Homo sapiens; identical to SEQ ID NO: 544818
  misc_feature: HIJSMM301DQ3YC.13.36.D03.1.454.light.4.raw

SEQ ID NO: 583093 - DNA, 497 bp, Homo sapiens; identical to SEQ ID NO: 535664
  misc_feature: HIJSMM301CR1J4.22.14.B03.1.454.light.4.raw

SEQ ID NO: 583094 - DNA, 479 bp, Homo sapiens
  misc_feature: HIJSMM301A7SDT.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgattatgctgcatccactttgcaaactggggtcccatccaggttcagcggcaggggatctgggacagatttcactctcaccatcagcagcctgcagcctgaagattttgcaacttactattgtcaacaggctaacagtttccctttaatcttcggccaagggacacgactggagattaaacgactagtggcgt

SEQ ID NO: 583095 - DNA, 494 bp, Homo sapiens
  misc_feature: HIJSMM301D4YUD.40.17.B06.1.454.light.4.raw
tctagcgactcacgaccggtgctcgatttagtcgatagtgaagggggtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgccgggccagtcagagtattagtacctggttggcctggtatcagcagaaaccagggaaagcccctaagttcctgatctataaggcgtctagtttagaaagtggggtcccatcaaggatcagcggcagtggatctgggacagaattcactctcaccattagtagcctgcagcctgatgattttgcaacttattactgccaacaatataatgatttccgtggacgttcggccaagggaccaaggtagaaatacaaacgaactagtggctgcaccatctgtcttcatctcccgcc

SEQ ID NO: 583096 - DNA, 494 bp, Homo sapiens
  misc_feature: HIJSMM301BFE9S.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacaactggccgtacacttttggcagggaccaaagctggagatcaatcgaaactgtggc

SEQ ID NO: 583097 - DNA, 490 bp, Homo sapiens; identical to SEQ ID NO: 535526
  misc_feature: HIJSMM301B3PJX.26.78.H01.1.454.light.4.raw

SEQ ID NO: 583098 - DNA, 497 bp, Homo sapiens; identical to SEQ ID NO: 577310
  misc_feature: HIJSMM301B4QU8.3.33.C11.1.454.light.4.raw

SEQ ID NO: 583099 - DNA, 493 bp, Homo sapiens; identical to SEQ ID NO: 535047
  misc_feature: HIJSMM301AL7UG.16.53.E09.1.454.light.4.raw

SEQ ID NO: 583100 - DNA, 513 bp, Homo sapiens; identical to SEQ ID NO: 546362
  misc_feature: HIJSMM301BRQ45.16.66.F11.1.454.light.4.raw

SEQ ID NO: 583101 - DNA, 490 bp, Homo sapiens; identical to SEQ ID NO: 540409
  misc_feature: HIJSMM301C5B2N.15.8.A08.1.454.light.4.raw

SEQ ID NO: 583102 - DNA, 446 bp, Homo sapiens; identical to SEQ ID NO: 537330
  misc_feature: HIJSMM301ELV4J.18.9.A09.1.454.light.4.raw

SEQ ID NO: 583103 - DNA, 494 bp, Homo sapiens; identical to SEQ ID NO: 534994
  misc_feature: HIJSMM301D00E1.27.78.H01.1.454.light.4.raw

SEQ ID NO: 583104 - DNA, 482 bp, Homo sapiens
  misc_feature: HIJSMM301DF56X.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttcggcggtcgggacc

SEQ ID NO: 583105 - DNA, 494 bp, Homo sapiens
  misc_feature: HIJSMM301AOHZX.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcaatggatctgggacagaattcactctcaccatcaacagcctgcagcctgatgatttggcaacttactactgccaaccgtatagtacttattcggtcaccttcggccaagggacacgactggagaattaaacgaactgtggctgcaccatctgtcttcat

SEQ ID NO: 583106 - DNA, 500 bp, Homo sapiens
  misc_feature: HIJSMM301AELNP.43.15.B04.1.454.light.4.raw
tgtgagtagtcacgaccggtgctcgattagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagactggaacctgaagattttgcaatttattactgtcagcagtatgcctggtcgcctccggccctcactttcggcggagggaccgaaggtggagatcaaacgaactgtggctgcaccatctgtcttcatt

SEQ ID NO: 583107 - DNA, 494 bp, Homo sapiens
  misc_feature: HIJSMM301BPX0D.19.71.G05.1.454.light.4.raw
  modified_base (425)..(425): a, c, t, g, unknown or other
tactctcgtgcacgaccggtgctcgatttagtgtcgtcgcaagagagaggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttatattgtcaanaatattattatacttcgtggacgttcggccaagggaccaaggtggatatacagacgaactgtggctgca

SEQ ID NO: 583108 - DNA, 504 bp, Homo sapiens; identical to SEQ ID NO: 554472
  misc_feature: HIJSMM301BPTQP.8.28.C06.1.454.light.4.raw

SEQ ID NO: 583109 - DNA, 495 bp, Homo sapiens
  misc_feature: HIJSMM301BT82X.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctgactcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 583110 - DNA, 486 bp, Homo sapiens; identical to SEQ ID NO: 535385
  misc_feature: HIJSMM301CR1DQ.19.71.G05.1.454.light.4.raw

SEQ ID NO: 583111 - DNA, 502 bp, Homo sapiens
  misc_feature: HIJSMM301E4GZQ.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggcaagggacacgactggagattaaacg

SEQ ID NO: 583112 - DNA, 494 bp, Homo sapiens; identical to SEQ ID NO: 535276
  misc_feature: HIJSMM301DWQF7.16.6.A06.1.454.light.4.raw

SEQ ID NO: 583113 - DNA, 521 bp, Homo sapiens
  misc_feature: HIJSMM301CYYVQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccacct

SEQ ID NO: 583114 - DNA, 502 bp, Homo sapiens; identical to SEQ ID NO: 543695
  misc_feature: HIJSMM301D2X4J.19.78.H01.1.454.light.4.raw

SEQ ID NO: 583115 - DNA, 495 bp, Homo sapiens
  misc_feature: HIJSMM301CDL5H.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggtccaagggacacgacctggagattaaacgaactagtggctgcaccatctcgt

SEQ ID NO: 583116 - DNA, 483 bp, Homo sapiens
  misc_feature: HIJSMM301D6Y9H.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccagaacttttggccagggaccaagctggagatcaaacgaactgtggctgcaccat

SEQ ID NO: 583117 - DNA, 496 bp, Homo sapiens; identical to SEQ ID NO: 550698
  misc_feature: HIJSMM301APKKI.13.76.G10.1.454.light.4.raw

SEQ ID NO: 583118 - DNA, 484 bp, Homo sapiens; identical to SEQ ID NO: 535400
  misc_feature: HIJSMM301CVJL3.46.26.C04.1.454.light.4.raw

SEQ ID NO: 583119 - DNA, 488 bp, Homo sapiens; identical to SEQ ID NO: 535990
  misc_feature: HIJSMM301BTRI8.11.28.C06.1.454.light.4.raw

SEQ ID NO: 583120 - DNA, 493 bp, Homo sapiens; identical to SEQ ID NO: 535084
  misc_feature: HIJSMM301C49RJ.47.64.F09.1.454.light.4.raw

SEQ ID NO: 583121 - DNA, 500 bp, Homo sapiens
  misc_feature: HIJSMM301EDDZA.3.4.A04.1.454.light.4.raw
agacgcactccacgaccggtgctcgatttagagtagtgatcagggggtgagtctgagataaaagctcagctctacccttgccttgactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcgccgacggaccaa

SEQ ID NO: 583122 - DNA, 423 bp, Homo sapiens; identical to SEQ ID NO: 565152
  misc_feature: HIJSMM301C3I6I.9.25.C03.1.454.light.4.raw

SEQ ID NO: 583123 - DNA, 485 bp, Homo sapiens; identical to SEQ ID NO: 536040
  misc_feature: HIJSMM301CA27C.15.1.A01.1.454.light.4.raw

SEQ ID NO: 583124 - DNA, 491 bp, Homo sapiens; identical to SEQ ID NO: 535294
  misc_feature: HIJSMM301AQOAE.16.68.G02.1.454.light.4.raw

SEQ ID NO: 583125 - DNA, 488 bp, Homo sapiens
  misc_feature: HIJSMM301DHW9C.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcccccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 583126 - DNA, 505 bp, Homo sapiens; identical to SEQ ID NO: 535503
  misc_feature: HIJSMM301EJ16B.8.28.C06.1.454.light.4.raw

SEQ ID NO: 583127 - DNA, 501 bp, Homo sapiens; identical to SEQ ID NO: 536818
  misc_feature: HIJSMM301AK5GZ.12.82.H05.1.454.light.4.raw

SEQ ID NO: 583128 - DNA, 493 bp, Homo sapiens
  misc_feature: HIJSMM301EF44J.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgactgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcact

SEQ ID NO: 583129 - DNA, 495 bp, Homo sapiens
  misc_feature: HIJSMM301CAJ4N.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaagggaccgaaagtaggacgatcaagcgaactgtggctgcaccatctgtt

SEQ ID NO: 583130 - DNA, 486 bp, Homo sapiens; identical to SEQ ID NO: 542999
  misc_feature: HIJSMM301BN6ZI.17.55.E11.1.454.light.4.raw

SEQ ID NO: 583131 - DNA, 499 bp, Homo sapiens
  misc_feature: HIJSMM301EQ1IW.15.25.C03.1.454.light.4.raw
  modified_base (435)..(435): a, c, t, g, unknown or other
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctanaaacccccgatcaccttcggccgagggacacgcctggagattaaacgaactgtggctgcaccat

SEQ ID NO: 583132 - DNA, 494 bp, Homo sapiens; identical to SEQ ID NO: 538841
  misc_feature: HIJSMM301BJDAU.16.78.H01.1.454.light.4.raw

SEQ ID NO: 583133 - DNA, 476 bp, Homo sapiens
  misc_feature: HIJSMM301CTU6V.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttcggcggggggaccgaaggtggacgatcaaacgaact

SEQ ID NO: 583134 - DNA, 506 bp, Homo sapiens
  misc_feature: HIJSMM301CG3WL.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaacgcccccaaactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctcgaccgtcctgggtcagcccaaggctgcccctcggtcactctgttcccaccctcctctacgtcgtat

SEQ ID NO: 583135 - DNA, 509 bp, Homo sapiens
  misc_feature: HIJSMM301ARV3O.51.55.E11.1.454.light.4.raw
cgatcgtatacacgaccggtgctcgatttagcactcgcacgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactgggaccagcggtgacattggtgtttataactatgtctcctggtaccagcaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaatcaataacaattgggtgttcggcggagggaccaaactgaccgtcctaggtcagcccaaggctgccccctcggtca

SEQ ID NO: 583136 - DNA, 431 bp, Homo sapiens
  misc_feature: HIJSMM301BKDZ3.14.5.A05.1.454.light.4.raw
cgtctagtaccacgaccggtgctcgatttagatagatagacagggtgcctggagactgtgttgacacagtctccaggcaccctgtccttgtctccaggggaaagagccaccctctcctgcagggccagtcagagtgttgatacgtacttagcctggtaccaacagaaacctggccaggctcccaggctcctcatctatgatgcatccatcagggccactggcatcccagccaggttcagtggcagtgggtctgggacagacttcactctcaccatcagcagcctagagcctgaagattttgcagtttattactgtcagcagcgtaccaactggcctcctgcgctcactttcggcggagggaccaaggtggagatcaaacgaactgtggctgcaccatctgtcttcatcttcccgcatctgagtactagacg

SEQ ID NO: 583137 - DNA, 488 bp, Homo sapiens; identical to SEQ ID NO: 540827
  misc_feature: HIJSMM301BFIF3.15.49.E05.1.454.light.4.raw

SEQ ID NO: 583138 - DNA, 495 bp, Homo sapiens
  misc_feature: HIJSMM301B160C.51.35.D02.1.454.light.4.raw
cgatcgtatacacgaccggtgctcgatttagcacacgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccactgtcact

SEQ ID NO: 583139 - DNA, 496 bp, Homo sapiens; identical to SEQ ID NO: 537925
  misc_feature: HIJSMM301CTC2F.22.14.B03.1.454.light.4.raw

SEQ ID NO: 583140 - DNA, 493 bp, Homo sapiens; identical to SEQ ID NO: 549486
  misc_feature: HIJSMM301D6TWN.48.71.G05.1.454.light.4.raw

SEQ ID NO: 583141 - DNA, 504 bp, Homo sapiens
  misc_feature: HIJSMM301DHMOC.48.70.G04.1.454.light.4.raw
  modified_base (374)..(374): a, c, t, g, unknown or other
agtatacatacacgaccggtgctcgatttagtgtagtgtgaagggaaagggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttacnctcaccatcagtagcctgcaggctgaagatgtggcagtttatactgtcaacaatattattatactccgccgacgttcggccgggggaccaacgtggaaatcaaacgaactgtggctgcaccatctgtctt

SEQ ID NO: 583142 - DNA, 488 bp, Homo sapiens; identical to SEQ ID NO: 536861
  misc_feature: HIJSMM301CL2D6.12.88.H11.1.454.light.4.raw

SEQ ID NO: 583143 - DNA, 486 bp, Homo sapiens; identical to SEQ ID NO: 546042
  misc_feature: HIJSMM301EV327.14.53.E09.1.454.light.4.raw

SEQ ID NO: 583144 - DNA, 484 bp, Homo sapiens; identical to SEQ ID NO: 535400
  misc_feature: HIJSMM301BPYOM.46.26.C04.1.454.light.4.raw

SEQ ID NO: 583145 - DNA, 504 bp, Homo sapiens
  misc_feature: HIJSMM301AOKL3.5.59.F04.1.454.light.4.raw
atcagacacgcacgaccggtgctcgatttagtacacacacttagggattgggggagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcgaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaaggaccgaaggtggaaatacaacgaactagtggctgcaccatctgtcttcatcttcccgccta

SEQ ID NO: 583146 - DNA, 478 bp, Homo sapiens; identical to SEQ ID NO: 555043
  misc_feature: HIJSMM301C64TC.52.1.A01.1.454.light.4.raw

SEQ ID NO: 583147 - DNA, 505 bp, Homo sapiens
  misc_feature: HIJSMM301D9MYO.7.87.H10.1.454.light.4.raw
  modified_base (483)..(483): a, c, t, g, unknown or other
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgtccgaggaccgaaggtaggaagtacaacgaactagtggctgcaccanctgtcttcatcttccctccact

SEQ ID NO: 583148 - DNA, 483 bp, Homo sapiens
  misc_feature: HIJSMM301EIM30.49.28.C06.1.454.light.4.raw
agtcgagagacacgaccggtgctcgatttagagctcacgtattgggtttgggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgtttttggcctaggggaccaagctggagatcaagcgaactgtggctgcacat

SEQ ID NO: 583149 - DNA, 444 bp, Homo sapiens; identical to SEQ ID NO: 535192
  misc_feature: HIJSMM301BNEDW.5.9.A09.1.454.light.4.raw

SEQ ID NO: 583150 - DNA, 505 bp, Homo sapiens
  misc_feature: HIJSMM301BMJTC.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattacttgcatgcaaactacacacggccgctcactttcggcggagggaccaaggtggagatcaaacgaactgtggctgcacatctgt

SEQ ID NO: 583151 - DNA, 490 bp, Homo sapiens
  misc_feature: HIJSMM301C6GQ3.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttatactgtcagcaatatgaaagtattccttttacttcggccctgggaccaaagtggatatcaaacgaactgtggctgcaccat

SEQ ID NO: 583152 - DNA, 485 bp, Homo sapiens
  misc_feature: HIJSMM301BSTW2.11.76.G10.1.454.light.4.raw
cgagagataccacgaccggtgctcgatttagtcactcatacaggggacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttagttgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggtccaggggaccaggctggagatcagacgaactgtgg

SEQ ID NO: 583153 - DNA, 503 bp, Homo sapiens; identical to SEQ ID NO: 536834
  misc_feature: HIJSMM301BLRB6.2.35.D02.1.454.light.4.raw

SEQ ID NO: 583154 - DNA, 487 bp, Homo sapiens
  misc_feature: HIJSMM301CQPOE.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaacgaactgtggctgcacc

SEQ ID NO: 583155 - DNA, 447 bp, Homo sapiens; identical to SEQ ID NO: 535201
  misc_feature: HIJSMM301AV3MD.18.9.A09.1.454.light.4.raw

SEQ ID NO: 583156 - DNA, 513 bp, Homo sapiens
  misc_feature: HIJSMM301DEC7B.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggccaagctgaccgtcttaagtcagcccaaggctgccccctcggtcactctgttcccgccctcctcgctacg

SEQ ID NO: 583157 - DNA, 517 bp, Homo sapiens
  misc_feature: HIJSMM301DIG0K.13.55.E11.1.454.light.4.raw
tcacgtactacacgaccggtgctcgatttagcactcgcacgttgggtttggggagcctgggcctcaggaagcagcatcgggggtgccgcagccatggcctggaccgctctcctgctgagcctccttgctcactttacagcttctgtggcctcctatgagttgactcagccactctcagtgtcagtggccccgggacagacggccacaattccctgtgagggaaacaaccttagaagtcagaatgtccactggtaccagcagaagtcaggccaggcccctgtggtggtcatctatagggataataaccggccctctgggatccctgaccgattctctggctccaactcggggaacacggccaccctgaccatcaacagagcccaagacggggatgaggctgactattattgtcaggtgtgggacagcaccacggtgatattcggcggcgggaccaagctgaccgtcctaggtcagcccaaggctgccccctcggtcactctgttcccgccctccctct

SEQ ID NO: 583158 - DNA, 502 bp, Homo sapiens; identical to SEQ ID NO: 539314
  misc_feature: HIJSMM301DZ4TC.21.81.H04.1.454.light.4.raw

SEQ ID NO: 583159 - DNA, 461 bp, Homo sapiens
  misc_feature: HIJSMM301DVT2Q.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccactcagtgggctccagtctgatgatgaggctgattattactgtgcagcatgggatgacaccctgaatggtccttgtgtggttttcggcggagggaccaagctgaccgtcctaggtcagccaacggctgccccctcggtcactctgttcccaccctcctcgtatctctcg

SEQ ID NO: 583160 - DNA, 497 bp, Homo sapiens
  misc_feature: HIJSMM301DOLFU.48.35.D02.1.454.light.4.raw
agtatacatacacgaccggtgctcgatttagcacacgatagttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtgtattcggcgagggaccaagctgaccgtctaggtcagcccaaggctgccccctc

SEQ ID NO: 583161 - DNA, 517 bp, Homo sapiens
  misc_feature: HIJSMM301D36GF.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggaggaccaagctgaccgtcctaggtcagcccaaggctcgccccctcggtcactctcgttccccgccctcctcgctacgtagac

SEQ ID NO: 583162 - DNA, 493 bp, Homo sapiens; identical to SEQ ID NO: 544335
  misc_feature: HIJSMM301ESTG0.5.57.F02.1.454.light.4.raw

SEQ ID NO: 583163 - DNA, 502 bp, Homo sapiens; identical to SEQ ID NO: 541971
  misc_feature: HIJSMM301CR3UD.4.39.D06.1.454.light.4.raw

SEQ ID NO: 583164 - DNA, 503 bp, Homo sapiens; identical to SEQ ID NO: 582113
  misc_feature: HIJSMM301EMRT9.48.71.G05.1.454.light.4.raw

SEQ ID NO: 583165 - DNA, 489 bp, Homo sapiens
  misc_feature: HIJSMM301B8SB1.49.55.E11.1.454.light.4.raw
agtcgagagacacgaccggtgctcgatttagcactcgcacgttgggtttgggggctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggtcgggaggaccgagggtggagatacaaacgaacg

SEQ ID NO: 583166 - DNA, 444 bp, Homo sapiens; identical to SEQ ID NO: 534993
  misc_feature: HIJSMM301BKEHR.5.9.A09.1.454.light.4.raw

SEQ ID NO: 583167 - DNA, 498 bp, Homo sapiens; identical to SEQ ID NO: 535974
  misc_feature: HIJSMM301DPERZ.22.27.C05.1.454.light.4.raw

SEQ ID NO: 583168 - DNA, 489 bp, Homo sapiens
  misc_feature: HIJSMM301CBT24.26.37.D04.1.454.light.4.raw
  modified_base (395)..(395): a, c, t, g, unknown or other
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgngcaatttattactgtcagcaatataatacctggcctccgctcactttcggcggagggaccaaggttgagatcaaacgaactgtggctgcaccta

SEQ ID NO: 583169 - DNA, 529 bp, Homo sapiens
  misc_feature: HIJSMM301A2T5W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagtttttctcggggtcgttcggccgaacgggaaccgaagggtagggaaatacgaaaacgaaactaggtggtctgtcgaccactctcgtctttctatcctttcccccg

SEQ ID NO: 583170 - DNA, 490 bp, Homo sapiens; identical to SEQ ID NO: 536481
  misc_feature: HIJSMM301CSVMO.13.46.E02.1.454.light.4.raw

SEQ ID NO: 583171 - DNA, 420 bp, Homo sapiens
  misc_feature: HIJSMM301A8Z1G.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctcgttcccaccctcctccatactcgta

SEQ ID NO: 583172 - DNA, 447 bp, Homo sapiens; identical to SEQ ID NO: 535020
  misc_feature: HIJSMM301EN3IP.18.9.A09.1.454.light.4.raw

SEQ ID NO: 583173 - DNA, 485 bp, Homo sapiens
  misc_feature: HIJSMM301AO5D6.40.18.B07.1.454.light.4.raw
tctagcgactcacgaccggtgctcgatttagtcgctgcgtaagggggagtcagacccagtcaggacacagcatggacatgagggtccccgctcagctcctggggctcctgctgctctggctcccaggtaccaaatgtgacatccagatgacccagtctccttccaccctgtctgcatctgtaggagacagagtcaccatcacttgccgggccagtcagagtattagtacctggttggcctggtatcagcacaaaccaggggaagcccctaagctcctgatctataaggcatctagtttagaaagtggggtcccatccaggttcagcggcagtggatctgggacagaattcgctctcaccatcagcagcctgcagcctgatgattttgcaacttattactgccaacactatgatagttattctccgtacacctttggccaggggaccaaggtggagatcaagcgaactgtggctgcaccatctgtt

SEQ ID NO: 583174 - DNA, 485 bp, Homo sapiens
  misc_feature: HIJSMM301AH205.40.54.E10.1.454.light.4.raw
tctagcgactcacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccgaagctgaccgtcctaggtcagccc

SEQ ID NO: 583175 - DNA, 521 bp, Homo sapiens; identical to SEQ ID NO: 538715
  misc_feature: HIJSMM301CQM3D.27.23.C01.1.454.light.4.raw

SEQ ID NO: 583176 - DNA, 509 bp, Homo sapiens
  misc_feature: HIJSMM301EHLBY.40.16.B05.1.454.light.4.raw
tctagcgactcacgaccggtgctcgatttagagctcacgtaaggggggggtctcaggaggcagcactctcgggacgtctccaccatggcctgggctctgctcctcctcagcctcctcactcagggcacaggatcctggactcagtctgccctgactcagcctcgctcagtgtccgggtctcctggacagtcagtcaccctctcctgcactggaaccagcagtaatgttggtggttataactttgtctcctggtaccaacaccacccaggcaaagcccccaaattcttgatttatgatgtcaataagcggccctcaggggtccctgatcgcttctctggctccaagtctggcaacacggcctccctgacccatctctgggctccaggctgaggatgaggctgattattactgctgctcatttgcaggtagttttgggtgttcggcggagggaccaagctgaccgtcctaggtcagcccaaggctcgccccctcggtcactctgttcccta

SEQ ID NO: 583177 - DNA, 498 bp, Homo sapiens
  misc_feature: HIJSMM301EF9B6.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggcggagggaccaaggtggagatcaaacgaactgtggctgcacatctgtcttcatcttccccg

SEQ ID NO: 583178 - DNA, 492 bp, Homo sapiens
  misc_feature: HIJSMM301B2LAI.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgctt

SEQ ID NO: 583179 - DNA, 500 bp, Homo sapiens; identical to SEQ ID NO: 572786
  misc_feature: HIJSMM301BOVNY.5.86.H09.1.454.light.4.raw

SEQ ID NO: 583180 - DNA, 500 bp, Homo sapiens; identical to SEQ ID NO: 546095
  misc_feature: HIJSMM301EYD1E.52.78.H01.1.454.light.4.raw

SEQ ID NO: 583181 - DNA, 511 bp, Homo sapiens
  misc_feature: HIJSMM301DL6AQ.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagcccaaggccaacccactgtcactctgttcccgcct

SEQ ID NO: 583182 - DNA, 510 bp, Homo sapiens
  misc_feature: HIJSMM301AKR5Z.13.53.E09.1.454.light.4.raw
  modified_base (492)..(492): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacgaacggtaggaaagtactaagacgaacgtataggtcgtgcgacacnctgtcttctactctccgt

SEQ ID NO: 583183 - DNA, 527 bp, Homo sapiens
  misc_feature: HIJSMM301EBED1.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaccgaacggtaggaaggtacgaaacgaaactacgtaggcgtgcgaccactctgtcttctactcttcccgtcccactct

SEQ ID NO: 583184 - DNA, 484 bp, Homo sapiens
  misc_feature: HIJSMM301CM697.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctgttctgcggcggaccaacg

SEQ ID NO: 583185 - DNA, 488 bp, Homo sapiens
  misc_feature: HIJSMM301ADTTX.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaaattattactgctgctcatatgaaggttataacactatactattcggcggagggaccaagctgaccgtcctgcgtcagcccaaggctcgccccctcggtcactctcgttcccaccctcctcgctacgtaga

SEQ ID NO: 583186 - DNA, 484 bp, Homo sapiens; identical to SEQ ID NO: 576854
  misc_feature: HIJSMM301B4IHZ.52.23.C01.1.454.light.4.raw

SEQ ID NO: 583187 - DNA, 443 bp, Homo sapiens
  misc_feature: HIJSMM301CFLEA.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgttca

SEQ ID NO: 583188 - DNA, 506 bp, Homo sapiens
  misc_feature: HIJSMM301CK8M5.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggccccaggtggaggatgaaggagactactattgttactctccagagaaggatggtcatcattgggtgttcggcggagggaccgaagctgaccgtcctaagtcagcccaaggctgccccctcggtcactctgttcccacct

SEQ ID NO: 583189 - DNA, 498 bp, Homo sapiens; identical to SEQ ID NO: 535914
  misc_feature: HIJSMM301AQMVG.18.59.F04.1.454.light.4.raw

SEQ ID NO: 583190 - DNA, 467 bp, Homo sapiens
  misc_feature: HIJSMM301EZHJG.40.10.A10.1.454.light.4.raw
tctagcgactcacgaccggtgctcgatttagcgtcgatctcagggggcaggagtcagacccactcaggacacagcatggacatgagggtccccgctcagctcctggggctcctgctgctctggctcccaggtgccagatgcgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagtggcagtggatctggcacagagttcactctcaccatcagcaccctgcagcctgaagattttgcgacttatttctgtctacaagattctaattaccctcggacgttcggccaggggacccaaagtggatgtcaaccgaa

SEQ ID NO: 583191 - DNA, 503 bp, Homo sapiens
  misc_feature: HIJSMM301EFO70.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaaaggtggagatcaaacgaactgtggctgcaccatctgtctt

SEQ ID NO: 583192 - DNA, 498 bp, Homo sapiens; identical to SEQ ID NO: 544855
  misc_feature: HIJSMM301A87SR.18.59.F04.1.454.light.4.raw

SEQ ID NO: 583193 - DNA, 503 bp, Homo sapiens
  misc_feature: HIJSMM301BBY36.41.57.F02.1.454.light.4.raw
tctatactatcacgaccggtgctcgatttagctcgatatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 583194 - DNA, 511 bp, Homo sapiens
  misc_feature: HIJSMM301A498H.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgcccaacgggaccaacggtaggaagtacaacgaactagtaggctgcaccatacctgtcttctatccttccccg

SEQ ID NO: 583195 - DNA, 490 bp, Homo sapiens
  misc_feature: HIJSMM301BK9AT.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcggccaagggaccaaggtagaaatcaaacgaactagtggctgcaccatctgtt

SEQ ID NO: 583196 - DNA, 474 bp, Homo sapiens
  misc_feature: HIJSMM301EGH6R.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagctacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 583197 - DNA, 486 bp, Homo sapiens
  misc_feature: HIJSMM301CWDZU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtgacgttcggccaagggaccaaggtggatatcagacgaa

SEQ ID NO: 583198 - DNA, 523 bp, Homo sapiens
  misc_feature: HIJSMM301EFZYA.27.23.C01.1.454.light.4.raw
  modified_base (496)..(496): a, c, t, g, unknown or other
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaggggaccaggctgaccgtcctaggtcagcccaaggctnccccctcggtcactctgttcccaccct

SEQ ID NO: 583199 - DNA, 500 bp, Homo sapiens
  misc_feature: HIJSMM301EA04L.40.57.F02.1.454.light.4.raw
tctagcgactcacgaccggtgctcgatttagctcgatatagttgggtttggggggaagctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccacggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgacgtcctaggtcagcccaaggctgcccctc

SEQ ID NO: 583200 - DNA, 444 bp, Homo sapiens; identical to SEQ ID NO: 535192
  misc_feature: HIJSMM301BYNJQ.5.9.A09.1.454.light.4.raw

SEQ ID NO: 583201 - DNA, 485 bp, Homo sapiens
  misc_feature: HIJSMM301EB1BP.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggggcggcagcctcagtgaatgggtgttcggcggagggaccaaactgtccgtctaggtcagcccc

SEQ ID NO: 583202 - DNA, 503 bp, Homo sapiens; identical to SEQ ID NO: 538884
  misc_feature: HIJSMM301ANYTF.27.78.H01.1.454.light.4.raw

SEQ ID NO: 583203 - DNA, 496 bp, Homo sapiens; identical to SEQ ID NO: 561995
  misc_feature: HIJSMM301DGWK8.16.78.H01.1.454.light.4.raw

SEQ ID NO: 583204 - DNA, 498 bp, Homo sapiens; identical to SEQ ID NO: 544540
  misc_feature: HIJSMM301AEMHO.41.20.B09.1.454.light.4.raw

SEQ ID NO: 583205 - DNA, 496 bp, Homo sapiens; identical to SEQ ID NO: 537925
  misc_feature: HIJSMM301A1156.22.14.B03.1.454.light.4.raw

SEQ ID NO: 583206 - DNA, 486 bp, Homo sapiens; identical to SEQ ID NO: 537617
  misc_feature: HIJSMM301A94VZ.10.53.E09.1.454.light.4.raw

SEQ ID NO: 583207 - DNA, 502 bp, Homo sapiens; identical to SEQ ID NO: 544444
  misc_feature: HIJSMM301CIRGV.5.24.C02.1.454.light.4.raw

SEQ ID NO: 583208 - DNA, 472 bp, Homo sapiens
  misc_feature: HIJSMM301ESEAD.12.7.A07.1.454.light.4.raw
atacgacgtacacgaccggtgctcgatttagcacgtgtcgcagggggcaggagtcagacccactcaggacacagcatggacatgagggtccccgctcagctcctggggctcctgctgctctggctcccaggtgccacatgtgccatccagatgacccagtctccatcctccctgtctgcatctataggagacagagtcgccatcagttgccgggcaagtcagtacattagaaatgatttagcctggtatcagcagaaaccagggacagcccctcagctcctgatctatgctgcatccaatttacaaactgggtcccatcaaggttcagcggcagtggatctgcaacagacttcaatctcaccatcagcagcctgcagcctgaagattttgcaatttattactgtctgcaggattacacataccctcgaacgttcggccaagggaccgaaggtggaaagtcaaacgaactagt

SEQ ID NO: 583209 - DNA, 508 bp, Homo sapiens; identical to SEQ ID NO: 561027
  misc_feature: HIJSMM301A5QAA.47.85.H08.1.454.light.4.raw

SEQ ID NO: 583210 - DNA, 486 bp, Homo sapiens
  misc_feature: HIJSMM301COS8K.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacgatccgagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataattagttattggacgttcggccaggggaccaaggtcgaaagtgagacgaactgtggctgcaccat

SEQ ID NO: 583211 - DNA, 493 bp, Homo sapiens; identical to SEQ ID NO: 543949
  misc_feature: HIJSMM301BMGPV.16.68.G02.1.454.light.4.raw

SEQ ID NO: 583212 - DNA, 506 bp, Homo sapiens; identical to SEQ ID NO: 542696
  misc_feature: HIJSMM301ARCY7.7.71.G05.1.454.light.4.raw

SEQ ID NO: 583213 - DNA, 523 bp, Homo sapiens
  misc_feature: HIJSMM301BAFAC.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattatttgtagttcatatacaaccagtgacacttgggtgttcggcggagggaccaggctgaccgtcctaggtcagcccaaggctgccccctcggtcactcctgttcccaccct

SEQ ID NO: 583214 - DNA, 494 bp, Homo sapiens
  misc_feature: HIJSMM301ERSCM.43.77.G11.1.454.light.4.raw
tgtgagtagtcacgaccggtgctcgatttagctagtcactcaagggaaagggggcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgtctaggt

SEQ ID NO: 583215 - DNA, 459 bp, Homo sapiens
  misc_feature: HIJSMM301ES99C.10.86.H09.1.454.light.4.raw
catagtagtgcacgaccggtgctcgatttagtgctatagacttgggtttgggggctgtcccggggaagtgctggtaccaggatacataattcgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaaggctgccccctcggtcactctgttcccaccctcctccactactatg

SEQ ID NO: 583216 - DNA, 492 bp, Homo sapiens
  misc_feature: HIJSMM301BZM7L.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggcgtgaggatgttggcctttattactgcatgcaaggtatcttcctcccatacacttttggcccggggaccaacggtggatctcaaaagaactgtggctgcacca

SEQ ID NO: 583217 - DNA, 513 bp, Homo sapiens
  misc_feature: HIJSMM301BTADN.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaaggctgaccgtcttaagtcagcccaaggctgccccctcggtcactctgttcccaccctcct

SEQ ID NO: 583218 - DNA, 490 bp, Homo sapiens
  misc_feature: HIJSMM301BK0XF.26.23.C01.1.454.light.4.raw
  modified_base (487)..(487): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaatttcactctcaccatcagcgggctccagtctgaggactctgcaacttattactgccaacaatatgatatttattctccagcgttcggccaggggaccaaggtggaagtcaagcgaactgtggctgcaccatcngtt

SEQ ID NO: 583219 - DNA, 509 bp, Homo sapiens
  misc_feature: HIJSMM301BMHBJ.15.34.D01.1.454.light.4.raw
tctacgtagccacgaccggtgctcgatttagatcgtctgtgttgggtttgggaacctatgaacattctgtaggggccactgtcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtgggcgtggcatttgggtgttcggcggagggaccaaactgaccgtcctaggtcagcccaaggctgcccctcggtcactctgttcccaccctcctcgctacgtaga

SEQ ID NO: 583220 - DNA, 508 bp, Homo sapiens
  misc_feature: HIJSMM301C5VF2.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaaggctgccccccg

SEQ ID NO: 583221 - DNA, 506 bp, Homo sapiens
  misc_feature: HIJSMM301AM9I5.12.48.E04.1.454.light.4.raw
  modified_base (425)..(425): a, c, t, g, unknown or other
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggcctccaagtctggcacctcagcctccctggccatcagtgggctccagtctgaggatgaggctgattattactgtgcatcatgggctgacnccctgactgggtccgggagtgttcggcggagggaccaagctgaccgtcctaggtcagcccaaggcacgccccctggtcact

SEQ ID NO: 583222 - DNA, 490 bp, Homo sapiens; identical to SEQ ID NO: 537746
  misc_feature: HIJSMM301EXTLN.10.77.G11.1.454.light.4.raw

SEQ ID NO: 583223 - DNA, 495 bp, Homo sapiens; identical to SEQ ID NO: 539326
  misc_feature: HIJSMM301AT8ES.52.86.H09.1.454.light.4.raw

SEQ ID NO: 583224 - DNA, 479 bp, Homo sapiens; identical to SEQ ID NO: 535118
  misc_feature: HIJSMM301CD93B.13.59.F04.1.454.light.4.raw

SEQ ID NO: 583225 - DNA, 478 bp, Homo sapiens; identical to SEQ ID NO: 535129
  misc_feature: HIJSMM301DZB0N.11.11.A11.1.454.light.4.raw

SEQ ID NO: 583226 - DNA, 490 bp, Homo sapiens
  misc_feature: HIJSMM301DIZXD.19.15.B04.1.454.light.4.raw
tactctcgtgcacgaccggtgctcgatttagacagtatatatccgcgggggagctgctcagttaggacccagagggaaccatggaaaccccagcgcagcttctcttcctcctgctactctggctcccaggctcagaaaccaccggagaaattgtgttgacgcagtctccaggcaccctgtctttgtctccaggggaaagagccaccctctcctgcagctccagccagaatatccagagctactacatagcctggtaccatcagaagcctggccaggcctcccaggttcctcatctatgctgggtcccacagggccactggcatcccagacaggttcagtggcagtgggtctgggacagacttcactctcatcattagcagactggagcctgaagatttcgcagtgtattactgtcagcagtatggaagttcacctctgtcgttcggccaagggaccaaggtagaaatgaaacgaactgtggctgcaccat

SEQ ID NO: 583227 - DNA, 490 bp, Homo sapiens; identical to SEQ ID NO: 543909
  misc_feature: HIJSMM301BNOVY.14.55.E11.1.454.light.4.raw

SEQ ID NO: 583228 - DNA, 483 bp, Homo sapiens; identical to SEQ ID NO: 535413
  misc_feature: HIJSMM301ESJW0.26.78.H01.1.454.light.4.raw

SEQ ID NO: 583229 - DNA, 490 bp, Homo sapiens
  misc_feature: HIJSMM301A1J4H.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgtagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccatctgt

SEQ ID NO: 583230 - DNA, 482 bp, Homo sapiens
  misc_feature: HIJSMM301BHX2T.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggaagtggatctgggacagattttactttcaccatcagcagcctgcagcctgaagatattgcaacatattactgttcagcagtaatgataatctcccgatcaccttcgccaagggacacgactggagattaaaacgaactgtggctgca

SEQ ID NO: 583231 - DNA, 496 bp, Homo sapiens; identical to SEQ ID NO: 577011
  misc_feature: HIJSMM301AIYB9.51.5.A05.1.454.light.4.raw

SEQ ID NO: 583232 - DNA, 507 bp, Homo sapiens; identical to SEQ ID NO: 540930
  misc_feature: HIJSMM301BP3XM.8.34.D01.1.454.light.4.raw

SEQ ID NO: 583233 - DNA, 494 bp, Homo sapiens; identical to SEQ ID NO: 534994
  misc_feature: HIJSMM301EILGL.27.78.H01.1.454.light.4.raw

SEQ ID NO: 583234 - DNA, 505 bp, Homo sapiens
  misc_feature: HIJSMM301CS3HA.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcacgggacgcaaacatgggatgacaatctgagcggttgggtgttcggcggagggaccaaactgaccgttcctaggtcagcccaa

SEQ ID NO: 583235 - DNA, 513 bp, Homo sapiens; identical to SEQ ID NO: 552481
  misc_feature: HIJSMM301EJJIM.43.19.B08.1.454.light.4.raw

SEQ ID NO: 583236 - DNA, 487 bp, Homo sapiens; identical to SEQ ID NO: 536025
  misc_feature: HIJSMM301COHGQ.17.34.D01.1.454.light.4.raw

SEQ ID NO: 583237 - DNA, 501 bp, Homo sapiens
  misc_feature: HIJSMM301DFBIR.13.19.B08.1.454.light.4.raw
tcacgtactacacgaccggtgctcgatttagtgagtcagtaagggggtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaacatctggttttcggcgggggaccaagttgaccgtcgtgggtcagccaaggctgccccctcggtcactctcgttcccaccctcctct

SEQ ID NO: 583238 - DNA, 493 bp, Homo sapiens; identical to SEQ ID NO: 551028
  misc_feature: HIJSMM301BE32H.4.27.C05.1.454.light.4.raw

SEQ ID NO: 583239 - DNA, 487 bp, Homo sapiens; identical to SEQ ID NO: 539157
  misc_feature: HIJSMM301EN3QK.26.37.D04.1.454.light.4.raw

SEQ ID NO: 583240 - DNA, 487 bp, Homo sapiens; identical to SEQ ID NO: 553099
  misc_feature: HIJSMM301D9HXD.13.5.A05.1.454.light.4.raw

SEQ ID NO: 583241 - DNA, 502 bp, Homo sapiens; identical to SEQ ID NO: 551357
  misc_feature: HIJSMM301B4U9N.9.12.B01.1.454.light.4.raw

SEQ ID NO: 583242 - DNA, 485 bp, Homo sapiens
  misc_feature: HIJSMM301COWQR.49.38.D05.1.454.light.4.raw
agtcgagagacacgaccggtgctcgatttagtatctgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaggatgtggcagtgtattactgtcagcaatatcacactgctccgctcactttcggcggagggaccagggtggagatcaaaacg

SEQ ID NO: 583243 - DNA, 513 bp, Homo sapiens
  misc_feature: HIJSMM301D5EN1.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctcgccccctggcactctgttccccgcctcctcgagtagtaca

SEQ ID NO: 583244 - DNA, 502 bp, Homo sapiens
  misc_feature: HIJSMM301CQRCV.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctgggacagacttcactctcaccatcagtagactggagcctgaagattttgcagtttattactgtcagcagtatgggggctcacgtcgattcactttcggcctgggaccaaagtagatgtcaaacgaactgtggctgcaccatctgtctt

SEQ ID NO: 583245 - DNA, 484 bp, Homo sapiens; identical to SEQ ID NO: 535400
  misc_feature: HIJSMM301ANY18.46.26.C04.1.454.light.4.raw

SEQ ID NO: 583246 - DNA, 495 bp, Homo sapiens
  misc_feature: HIJSMM301BPM97.16.72.G06.1.454.light.4.raw
tgtactactccacgaccggtgctcgatttagctacgactgcaagggaaagggggaggaactgctcagttaggacacagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgctagtttattactgtcagcagtataataactggcctccggtcactttcggcggagggaccgaaggtggagatacaaacgaactgtggctgcaccattcg

SEQ ID NO: 583247 - DNA, 483 bp, Homo sapiens
  misc_feature: HIJSMM301ATLO2.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtca

SEQ ID NO: 583248 - DNA, 496 bp, Homo sapiens; identical to SEQ ID NO: 546893
  misc_feature: HIJSMM301BXGDM.51.35.D02.1.454.light.4.raw

SEQ ID NO: 583249 - DNA, 519 bp, Homo sapiens; identical to SEQ ID NO: 579876
  misc_feature: HIJSMM301DOV49.48.24.C02.1.454.light.4.raw

SEQ ID NO: 583250 - DNA, 506 bp, Homo sapiens; identical to SEQ ID NO: 576293
  misc_feature: HIJSMM301AT28O.18.37.D04.1.454.light.4.raw

SEQ ID NO: 583251 - DNA, 496 bp, Homo sapiens
  misc_feature: HIJSMM301DS5R8.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccaggtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactcgtggggtcccagacagattcagcggcagtggcactgatgtcacactgacaatcagcagggtggaggctgaggatggttggggtttggttcctccatgcaaggtacacactggccttttggccgagggaccaacctggagatcaaatgaactgtggctgcacatctgtctt

SEQ ID NO: 583252 - DNA, 475 bp, Homo sapiens; identical to SEQ ID NO: 537714
  misc_feature: HIJSMM301AH60L.7.81.H04.1.454.light.4.raw

SEQ ID NO: 583253 - DNA, 488 bp, Homo sapiens; identical to SEQ ID NO: 535861
  misc_feature: HIJSMM301BH02W.14.55.E11.1.454.light.4.raw

SEQ ID NO: 583254 - DNA, 501 bp, Homo sapiens; identical to SEQ ID NO: 535746
  misc_feature: HIJSMM301BFAQW.18.11.A11.1.454.light.4.raw

SEQ ID NO: 583255 - DNA, 527 bp, Homo sapiens
  misc_feature: HIJSMM301D1LNG.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctacaaaagaagtagccctctcgtggttttcggcgggggaccgaaggtgaccgtcctaagtcagcccaaggctcgccccctcggtcactctcgttcccaccctcctcacg

SEQ ID NO: 583256 - DNA, 492 bp, Homo sapiens
  misc_feature: HIJSMM301B9T50.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgtgctaggacgaacggtaggaagtacgaaacgaaactacgtaggtcgtgtcgacca

SEQ ID NO: 583257 - DNA, 463 bp, Homo sapiens; identical to SEQ ID NO: 535008
  misc_feature: HIJSMM301AMJ15.10.9.A09.1.454.light.4.raw

SEQ ID NO: 583258 - DNA, 447 bp, Homo sapiens; identical to SEQ ID NO: 535020
  misc_feature: HIJSMM301BOZGW.18.9.A09.1.454.light.4.raw

SEQ ID NO: 583259 - DNA, 493 bp, Homo sapiens
  misc_feature: HIJSMM301CBIQ9.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgactgggttttattctactttcggccctgggaccaaagtggatttcagacgaactgtggctgcaccatctgtcttcta

SEQ ID NO: 583260 - DNA, 521 bp, Homo sapiens
  misc_feature: HIJSMM301BHNEO.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccgaaggaccgaaggtggcaatcaaccgaactgtggctgcaccatctgtcttctatctttccccg

SEQ ID NO: 583261 - DNA, 492 bp, Homo sapiens; identical to SEQ ID NO: 570552
  misc_feature: HIJSMM301D4HNO.9.19.B08.1.454.light.4.raw

SEQ ID NO: 583262 - DNA, 482 bp, Homo sapiens; identical to SEQ ID NO: 538815
  misc_feature: HIJSMM301DBKAV.4.34.D01.1.454.light.4.raw

SEQ ID NO: 583263 - DNA, 510 bp, Homo sapiens
  misc_feature: HIJSMM301AXR4A.48.15.B04.1.454.light.4.raw
agtatacatacacgaccggtgctcgatttagacagtatatatccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaaataaaacgaactagtggctgcaccatctgtcttcta

SEQ ID NO: 583264 - DNA, 486 bp, Homo sapiens
  misc_feature: HIJSMM301D7A6H.49.68.G02.1.454.light.4.raw
agtcgagagacacgaccggtgctcgatttagtcgatagtgaagggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccggggtccctgacaggttcagtggcagtggatcaggcacagattttacactgaaaatcagcagagtggaggctgaggatgttgggatttattactgcatgcaagctctacaagctcctcagctcactttcggcggagggaccaaggtggagatacaaacgaa

SEQ ID NO: 583265 - DNA, 506 bp, Homo sapiens
  misc_feature: HIJSMM301DIR1B.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctggtcactctgttcccacct

SEQ ID NO: 583266 - DNA, 516 bp, Homo sapiens
  misc_feature: HIJSMM301B14ZS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgcccctcggcactctgtcccacct

SEQ ID NO: 583267 - DNA, 484 bp, Homo sapiens; identical to SEQ ID NO: 535441
  misc_feature: HIJSMM301DBKKI.26.60.F05.1.454.light.4.raw

SEQ ID NO: 583268 - DNA, 476 bp, Homo sapiens; identical to SEQ ID NO: 538026
  misc_feature: HIJSMM301B4P3M.13.76.G10.1.454.light.4.raw

SEQ ID NO: 583269 - DNA, 480 bp, Homo sapiens; identical to SEQ ID NO: 557442
  misc_feature: HIJSMM301CAXVI.8.53.E09.1.454.light.4.raw

SEQ ID NO: 583270 - DNA, 496 bp, Homo sapiens
  misc_feature: HIJSMM301CV38P.26.78.H01.1.454.light.4.raw
agactatactcacgaccggtgctcgatttagtgtgagtagtttgggtttgggggagggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagatttgctactttattactgtcagcagcgtagcaactggcctctcacgtttcggcggagggaccgaggggtggagatcaagacgaactgtggctgcaccatctgtt

SEQ ID NO: 583271 - DNA, 497 bp, Homo sapiens
  misc_feature: HIJSMM301AU4WI.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaacttgcgaccaaggtcaccgtcctgggtcagcccaaggccaaccccactgtcactctcg

SEQ ID NO: 583272 - DNA, 487 bp, Homo sapiens; identical to SEQ ID NO: 535863
  misc_feature: HIJSMM301CC5L5.19.71.G05.1.454.light.4.raw

SEQ ID NO: 583273 - DNA, 513 bp, Homo sapiens; identical to SEQ ID NO: 564131
  misc_feature: HIJSMM301CNHFZ.14.78.H01.1.454.light.4.raw

SEQ ID NO: 583274 - DNA, 489 bp, Homo sapiens
  misc_feature: HIJSMM301DM3PL.10.59.F04.1.454.light.4.raw
catagtagtgcacgaccggtgctcgatttagtacacacacttagggattggggggggtctcaggaggcagcactctcgggacgtctccaccatggcctgggctctgctcctcctcagcctcctcactcagggcacaggatcctgggctcagtctgccctgactcagcctcgctcagtgtccgggtctcctgggcagtcagtcaccatctcctgcactggaaccagcagtgatgttggtggttatgactttgtctcctggtaccaacagcagccaggcgaagcccccaaattcatgatttatgatgtcagtgcgcggccctcggggtccctgatcgcttctctggctccaagtctggcaacacggcctccctgaccatctctggcctccagcctgaggatgaggctgattattactgttgctcatatgcaggcggtaccgcgttgggtggttcggcggagggaccaagctgaccgtcctaggtcagcccg

SEQ ID NO: 583275 - DNA, 495 bp, Homo sapiens; identical to SEQ ID NO: 536359
  misc_feature: HIJSMM301BFH4P.48.4.A04.1.454.light.4.raw

SEQ ID NO: 583276 - DNA, 486 bp, Homo sapiens; identical to SEQ ID NO: 536261
  misc_feature: HIJSMM301DT9YW.26.55.E11.1.454.light.4.raw

SEQ ID NO: 583277 - DNA, 516 bp, Homo sapiens
  misc_feature: HIJSMM301A8ZRI.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgacccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgttcccgccctcctcg

SEQ ID NO: 583278 - DNA, 509 bp, Homo sapiens
  misc_feature: HIJSMM301D42O7.51.86.H09.1.454.light.4.raw
cgatcgtatacacgaccggtgctcgatttagtgctatagacttgggtttggggactgatcaggactcctcagttcaccttctcacaatgaggctccctgctcagctcctggggctgctaatgctctgggtcccaggttccagtggggatgttgtgctgactcagtctccactctccctgcccgtcacccttggacagccggcctccatctcctgcaggtctagtcaaggcctcctatatagtgatggaaacacctacttgaattggtttcagcagaggccaggccaatctccaagacgcctaatttataaggtttctaaccgggactctggggtcccagacagattcagcggcagtgggtcaggcactgatttcacactgataatcgacagggtggaggctgaggatgttgggttttattactgcatgcaaggtacacactggcctgggacgttcggccaagggaccaaggtggaaatacaaacgaactgtggctgcaccatctgtctt

SEQ ID NO: 583279 - DNA, 469 bp, Homo sapiens; identical to SEQ ID NO: 536091
  misc_feature: HIJSMM301CLTVU.3.82.H05.1.454.light.4.raw

SEQ ID NO: 583280 - DNA, 505 bp, Homo sapiens
  misc_feature: HIJSMM301BOBWZ.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccactgtca

SEQ ID NO: 583281 - DNA, 494 bp, Homo sapiens; identical to SEQ ID NO: 534992
  misc_feature: HIJSMM301ARRCX.9.1.A01.1.454.light.4.raw

SEQ ID NO: 583282 - DNA, 447 bp, Homo sapiens; identical to SEQ ID NO: 535201
  misc_feature: HIJSMM301EN6WH.18.9.A09.1.454.light.4.raw

SEQ ID NO: 583283 - DNA, 486 bp, Homo sapiens
  misc_feature: HIJSMM301CRMQJ.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcgaggggggacgtatccctgatcgcttctcaggctccggctctgggactgagcgctacctcaccatctccagcctccagtctgaggacgagggtgactattactgtcagacgtgggacactggcagtttgggtgttcgggcggagggaccaagttgaccgtctaggtcagcccaaggctcg

SEQ ID NO: 583284 - DNA, 493 bp, Homo sapiens
  misc_feature: HIJSMM301EIVTE.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggaggaccgagggtggagatcaaacgaactgtggctgcaccatctgtcttcta

SEQ ID NO: 583285 - DNA, 523 bp, Homo sapiens
  misc_feature: HIJSMM301A01QN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccacggggtttctgatcgcttctatggctccaagtctgcctacacggcctccctcgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 583286 - DNA, 491 bp, Homo sapiens; identical to SEQ ID NO: 555285
  misc_feature: HIJSMM301BCBI7.48.1.A01.1.454.light.4.raw

SEQ ID NO: 583287 - DNA, 447 bp, Homo sapiens; identical to SEQ ID NO: 535201
  misc_feature: HIJSMM301B8NXA.18.9.A09.1.454.light.4.raw

SEQ ID NO: 583288 - DNA, 520 bp, Homo sapiens; identical to SEQ ID NO: 546048
  misc_feature: HIJSMM301DY8XV.27.23.C01.1.454.light.4.raw

SEQ ID NO: 583289 - DNA, 485 bp, Homo sapiens
  misc_feature: HIJSMM301A1DKK.47.45.E01.1.454.light.4.raw
agctcacgtacacgaccggtgctcgatttagtgagtcagtaagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacgactggagattaaacgaactgtggctgcaccat

SEQ ID NO: 583290 - DNA, 494 bp, Homo sapiens
  misc_feature: HIJSMM301ADKRK.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggccaacgggaccgaaggtaggaaagtacaaacgaactagtggcgtgtcaccctaa

SEQ ID NO: 583291 - DNA, 485 bp, Homo sapiens; identical to SEQ ID NO: 535985
  misc_feature: HIJSMM301AMYDJ.15.1.A01.1.454.light.4.raw

SEQ ID NO: 583292 - DNA, 481 bp, Homo sapiens
  misc_feature: HIJSMM301AOOBH.4.14.B03.1.454.light.4.raw
agcactgtagcacgaccggtgctcgatttagtgtgagtagttccgcgggggcaggagtcagactcagtcaggacacagcatggacatgagggtccccgctcagctcctggggctcctgctgctctggctcccaggtgccagatgtgacatccaaatgacccagtctccttccaccctgtctgcatctgtgggagacagagtcactatcacttgccgggccagtcagagcattagtggctggctggcctggtatcagcagaaaccagggagagcccctaagctcttgatctttgatgccaccaatttggaaagtggggtcccatcaagattcagcggcagtggatttgggacagaattcactctcaccatcagcagcctgcagcctggtgattttgcaacttattactgccaacagtataatagttattctctcactttcggtcggagggaccaaggtggagatcaaacgaactagtggtcg

SEQ ID NO: 583293 - DNA, 444 bp, Homo sapiens; identical to SEQ ID NO: 536685
  misc_feature: HIJSMM301AXQE9.10.76.G10.1.454.light.4.raw

SEQ ID NO: 583294 - DNA, 522 bp, Homo sapiens; identical to SEQ ID NO: 539966
  misc_feature: HIJSMM301DMX1V.27.23.C01.1.454.light.4.raw

SEQ ID NO: 583295 - DNA, 493 bp, Homo sapiens; identical to SEQ ID NO: 535770
  misc_feature: HIJSMM301EPIDA.51.71.G05.1.454.light.4.raw

SEQ ID NO: 583296 - DNA, 507 bp, Homo sapiens; identical to SEQ ID NO: 559118
  misc_feature: HIJSMM301EBLKO.17.87.H10.1.454.light.4.raw

SEQ ID NO: 583297 - DNA, 505 bp, Homo sapiens; identical to SEQ ID NO: 551816
  misc_feature: HIJSMM301DWHN8.18.78.H01.1.454.light.4.raw

SEQ ID NO: 583298 - DNA, 520 bp, Homo sapiens; identical to SEQ ID NO: 572224
  misc_feature: HIJSMM301C927I.9.38.D05.1.454.light.4.raw

SEQ ID NO: 583299 - DNA, 489 bp, Homo sapiens
  misc_feature: HIJSMM301DK8U8.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtggaatgggtgttcggcggagggaccaaactgtccgtcctaggtcagaccccg

SEQ ID NO: 583300 - DNA, 447 bp, Homo sapiens; identical to SEQ ID NO: 535201
  misc_feature: HIJSMM301BV1OI.18.9.A09.1.454.light.4.raw

SEQ ID NO: 583301 - DNA, 493 bp, Homo sapiens; identical to SEQ ID NO: 535047
  misc_feature: HIJSMM301D4YVX.16.53.E09.1.454.light.4.raw

SEQ ID NO: 583302 - DNA, 504 bp, Homo sapiens; identical to SEQ ID NO: 539083
  misc_feature: HIJSMM301COCOY.8.19.B08.1.454.light.4.raw

SEQ ID NO: 583303 - DNA, 515 bp, Homo sapiens
  misc_feature: HIJSMM301EWDEX.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacggaggctgattattactgccactcatatagaagtagtactactcctgtggttttcggcggagggaccaagctgaccgtcctaggtcagcccaaggctgccccctcggtcactctgttccccg

SEQ ID NO: 583304 - DNA, 497 bp, Homo sapiens; identical to SEQ ID NO: 540619
  misc_feature: HIJSMM301BE7IQ.15.25.C03.1.454.light.4.raw

SEQ ID NO: 583305 - DNA, 485 bp, Homo sapiens; identical to SEQ ID NO: 536263
  misc_feature: HIJSMM301DB5X7.47.78.H01.1.454.light.4.raw

SEQ ID NO: 583306 - DNA, 500 bp, Homo sapiens; identical to SEQ ID NO: 547703
  misc_feature: HIJSMM301BIH30.43.34.D01.1.454.light.4.raw

SEQ ID NO: 583307 - DNA, 485 bp, Homo sapiens; identical to SEQ ID NO: 536799
  misc_feature: HIJSMM301B8K3K.19.71.G05.1.454.light.4.raw

SEQ ID NO: 583308 - DNA, 444 bp, Homo sapiens; identical to SEQ ID NO: 535856
  misc_feature: HIJSMM301DSUF3.9.9.A09.1.454.light.4.raw

SEQ ID NO: 583309 - DNA, 492 bp, Homo sapiens
  misc_feature: HIJSMM301CZ5ZG.19.71.G05.1.454.light.4.raw
tactctcgtgcacgaccggtgctcgatttagtgtcgtcgcaagagagagggggtcaggctggaactcgaggagcaggcaggggcagcaacgatggtgttgcagacccaggtcttcatttctctgttgctctggatctctggtgccccacggggacatcgtgactgacccagtctccgtagactccctggctgtgtctctgggcgagcgggccaccatcaactgcaagtccagccacaatcttttataccagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtat

SEQ ID NO: 583310 - DNA, 505 bp, Homo sapiens; identical to SEQ ID NO: 542298
  misc_feature: HIJSMM301ARW8Z.14.3.A03.1.454.light.4.raw

SEQ ID NO: 583311 - DNA, 505 bp, Homo sapiens
  misc_feature: HIJSMM301CX6ZD.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatacaaacgaactgtggctgcaccatctgtctt

SEQ ID NO: 583312 - DNA, 502 bp, Homo sapiens; identical to SEQ ID NO: 541971
  misc_feature: HIJSMM301EY4FG.4.39.D06.1.454.light.4.raw

SEQ ID NO: 583313 - DNA, 494 bp, Homo sapiens; identical to SEQ ID NO: 564757
  misc_feature: HIJSMM301BC0I3.51.81.H04.1.454.light.4.raw

SEQ ID NO: 583314 - DNA, 523 bp, Homo sapiens
  misc_feature: HIJSMM301BVBB8.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctcgttcccaccct

SEQ ID NO: 583315 - DNA, 488 bp, Homo sapiens
  misc_feature: HIJSMM301AUQT9.41.57.F02.1.454.light.4.raw
tctatactatcacgaccggtgctcgatttagctcgatatagttgggtttggggaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgaccgtcctaggtcagccccg

SEQ ID NO: 583316 - DNA, 509 bp, Homo sapiens
  misc_feature: HIJSMM301EU6WK.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacacgcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctcgccccctcggtcactcttccg

SEQ ID NO: 583317 - DNA, 487 bp, Homo sapiens
  misc_feature: HIJSMM301CYZTI.52.35.D02.1.454.light.4.raw
cgcagtacgacacgaccggtgctcgatttagcacacgatagttgggtttgggggaagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcagtgggtctgggacagacttcactctcaccatcagcagggtggagcctgaggattttgcagtgtattattgtcagcactatggtaggtcacagtacacttttggccaggggaccaagctggagatcaaacgaactgtggctgcacc

SEQ ID NO: 583318 - DNA, 495 bp, Homo sapiens; identical to SEQ ID NO: 535007
  misc_feature: HIJSMM301DMZ1K.22.5.A05.1.454.light.4.raw

SEQ ID NO: 583319 - DNA, 404 bp, Homo sapiens; identical to SEQ ID NO: 535530
  misc_feature: HIJSMM301DVDL0.4.35.D02.1.454.light.4.raw

SEQ ID NO: 583320 - DNA, 489 bp, Homo sapiens; identical to SEQ ID NO: 542780
  misc_feature: HIJSMM301CP1RI.16.53.E09.1.454.light.4.raw

SEQ ID NO: 583321 - DNA, 494 bp, Homo sapiens; identical to SEQ ID NO: 534992
  misc_feature: HIJSMM301DOS6V.9.1.A01.1.454.light.4.raw

SEQ ID NO: 583322 - DNA, 496 bp, Homo sapiens; identical to SEQ ID NO: 564773
  misc_feature: HIJSMM301C6AKL.15.31.C09.1.454.light.4.raw

SEQ ID NO: 583323 - DNA, 454 bp, Homo sapiens; identical to SEQ ID NO: 534964
  misc_feature: HIJSMM301ELWXU.19.86.H09.1.454.light.4.raw

SEQ ID NO: 583324 - DNA, 521 bp, Homo sapiens; identical to SEQ ID NO: 538715
  misc_feature: HIJSMM301CG6XR.27.23.C01.1.454.light.4.raw

SEQ ID NO: 583325 - DNA, 481 bp, Homo sapiens; identical to SEQ ID NO: 539249
  misc_feature: HIJSMM301C9IQO.11.76.G10.1.454.light.4.raw

SEQ ID NO: 583326 - DNA, 511 bp, Homo sapiens
  misc_feature: HIJSMM301A4D4O.4.1.A01.1.454.light.4.raw
agcactgtagcacgaccggtgctcgatttagacgtctcatcaggggggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgattgttgctagtttattactgtcatacaatagtggtcggacccggccctacggttccggaccgaacgggaaccgaagggtaggaaactaccgaaaacgaactggtggctgccaccattctgttccttcta

SEQ ID NO: 583327 - DNA, 475 bp, Homo sapiens
  misc_feature: HIJSMM301D1DAN.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgctagtttattactgtcagcaatataacaagtggccattcactttcggcccagggaccaaagtggatatcaaacgaactgtggctgcaccatctgtcttcattccttcccgccat

SEQ ID NO: 583328 - DNA, 493 bp, Homo sapiens; identical to SEQ ID NO: 542591
  misc_feature: HIJSMM301DXZF0.9.1.A01.1.454.light.4.raw

SEQ ID NO: 583329 - DNA, 500 bp, Homo sapiens
  misc_feature: HIJSMM301AKUQ5.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccac

SEQ ID NO: 583330 - DNA, 513 bp, Homo sapiens; identical to SEQ ID NO: 543313
  misc_feature: HIJSMM301CQ110.22.36.D03.1.454.light.4.raw

SEQ ID NO: 583331 - DNA, 494 bp, Homo sapiens; identical to SEQ ID NO: 538230
  misc_feature: HIJSMM301DW9N6.11.71.G05.1.454.light.4.raw

SEQ ID NO: 583332 - DNA, 501 bp, Homo sapiens
  misc_feature: HIJSMM301CRF3G.41.30.C08.1.454.light.4.raw
tctatactatcacgaccggtgctcgatttagtctgacgtcaaagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctcg

SEQ ID NO: 583333 - DNA, 489 bp, Homo sapiens; identical to SEQ ID NO: 535139
  misc_feature: HIJSMM301EMCRS.14.55.E11.1.454.light.4.raw

SEQ ID NO: 583334 - DNA, 519 bp, Homo sapiens
  misc_feature: HIJSMM301CB449.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgccctgaacctgaaggccaatgagacccaagacaggccaagtgggttgtgagacccctgaggagctgggccctggtcccaggcagcgctggcccctgttgctgctgggtctggccatggtcgcccatggcctgctgcgcccaatggttgcaccgcaaagcggggacccagaccctggagcctcagttggaagcagccgatccagcctgcggagcctgtggggcaggtcagccaaggctgccccctcggtcactctgttcccgccctcctccacgacg

SEQ ID NO: 583335 - DNA, 502 bp, Homo sapiens; identical to SEQ ID NO: 554122
  misc_feature: HIJSMM301ESOFP.2.35.D02.1.454.light.4.raw

SEQ ID NO: 583336 - DNA, 494 bp, Homo sapiens
  misc_feature: HIJSMM301C2GSN.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatatcctcctcagacttcggccaagggaccaaggtggaaatcaaacgaactgtggctgcacc

SEQ ID NO: 583337 - DNA, 507 bp, Homo sapiens
  misc_feature: HIJSMM301C3R4D.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagccaaggctgtccccccg

SEQ ID NO: 583338 - DNA, 489 bp, Homo sapiens; identical to SEQ ID NO: 535139
  misc_feature: HIJSMM301EWYKO.14.55.E11.1.454.light.4.raw

SEQ ID NO: 583339 - DNA, 500 bp, Homo sapiens
  misc_feature: HIJSMM301BSUC4.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcact

SEQ ID NO: 583340 - DNA, 503 bp, Homo sapiens; identical to SEQ ID NO: 535044
  misc_feature: HIJSMM301C21N9.19.78.H01.1.454.light.4.raw

SEQ ID NO: 583341 - DNA, 489 bp, Homo sapiens; identical to SEQ ID NO: 553430
  misc_feature: HIJSMM301B6YJR.14.55.E11.1.454.light.4.raw

SEQ ID NO: 583342 - DNA, 482 bp, Homo sapiens
  misc_feature: HIJSMM301ADU13.48.2.A02.1.454.light.4.raw
agtatacatacacgaccggtgctcgatttagactcatctacagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcacaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccgaggggaccgaaacgtaggatgtcaaccgaacctagtggctgcacca

SEQ ID NO: 583343 - DNA, 507 bp, Homo sapiens; identical to SEQ ID NO: 559118
  misc_feature: HIJSMM301DRBYO.17.87.H10.1.454.light.4.raw

SEQ ID NO: 583344 - DNA, 501 bp, Homo sapiens; identical to SEQ ID NO: 535873
  misc_feature: HIJSMM301DED0I.17.27.C05.1.454.light.4.raw

SEQ ID NO: 583345 - DNA, 514 bp, Homo sapiens
  misc_feature: HIJSMM301BZEFY.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctctatttttgacaataataagcgaccctcagggattcctgaccgattctctggctccaagtctggcacgtcagccaccctgggcatcaccggactccagactggggacagggccgattattactgcggaacatgggatagcagcctgagtactgtgataatcggcggagggaccaagctgaccgtcctaggtcagcccgaagctcgccccctcggtcactctcgttcccta

SEQ ID NO: 583346 - DNA, 499 bp, Homo sapiens
  misc_feature: HIJSMM301ALVUH.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggaccgtcaaacgaactagtggctgcaccat

SEQ ID NO: 583347 - DNA, 507 bp, Homo sapiens
  misc_feature: HIJSMM301BDX59.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatcctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaagggtggacctcaaacgaactgtggctggcaccatctgtcttcatcttccgcc

SEQ ID NO: 583348 - DNA, 509 bp, Homo sapiens
  misc_feature: HIJSMM301AYS4O.48.35.D02.1.454.light.4.raw
agtatacatacacgaccggtgctcgatttagcacacgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctgccccctcggtccactctgttcccg

SEQ ID NO: 583349 - DNA, 496 bp, Homo sapiens; identical to SEQ ID NO: 538625
  misc_feature: HIJSMM301DMLUP.2.49.E05.1.454.light.4.raw

SEQ ID NO: 583350 - DNA, 493 bp, Homo sapiens; identical to SEQ ID NO: 544835
  misc_feature: HIJSMM301EW8DG.43.29.C07.1.454.light.4.raw

SEQ ID NO: 583351 - DNA, 504 bp, Homo sapiens; identical to SEQ ID NO: 557936
  misc_feature: HIJSMM301AIXF3.19.78.H01.1.454.light.4.raw

SEQ ID NO: 583352 - DNA, 486 bp, Homo sapiens; identical to SEQ ID NO: 535043
  misc_feature: HIJSMM301EJBC1.46.35.D02.1.454.light.4.raw

SEQ ID NO: 583353 - DNA, 487 bp, Homo sapiens; identical to SEQ ID NO: 538190
  misc_feature: HIJSMM301B0EZ6.47.70.G04.1.454.light.4.raw

SEQ ID NO: 583354 - DNA, 497 bp, Homo sapiens; identical to SEQ ID NO: 534982
  misc_feature: HIJSMM301DPOVU.26.80.H03.1.454.light.4.raw

SEQ ID NO: 583355 - DNA, 524 bp, Homo sapiens
  misc_feature: HIJSMM301BHT24.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctccggtcgactctcgttcccgccct

SEQ ID NO: 583356 - DNA, 447 bp, Homo sapiens; identical to SEQ ID NO: 535020
  misc_feature: HIJSMM301BSTAD.18.9.A09.1.454.light.4.raw

SEQ ID NO: 583357 - DNA, 505 bp, Homo sapiens; identical to SEQ ID NO: 535503
  misc_feature: HIJSMM301AN2RC.8.28.C06.1.454.light.4.raw

SEQ ID NO: 583358 - DNA, 479 bp, Homo sapiens; identical to SEQ ID NO: 535188
  misc_feature: HIJSMM301BP91B.10.74.G08.1.454.light.4.raw

SEQ ID NO: 583359 - DNA, 475 bp, Homo sapiens
  misc_feature: HIJSMM301D5EFT.48.68.G02.1.454.light.4.raw
  modified_base (448)..(448): a, c, t, g, unknown or other
agtatacatacacgaccggtgctcgatttagtcgatagtgaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcagggtccctgatcgcttctctggctcccagtctggcaacacggcctccctgaccatctctgggctccaggctgaggatgaggctgattattactgctgctcatatgcaggcagctacactttggngttcggcggagggaccaagctgactgt

SEQ ID NO: 583360 - DNA, 524 bp, Homo sapiens
  misc_feature: HIJSMM301EWB54.17.75.G09.1.454.light.4.raw
cgtagactagcacgaccggtgctcgatttagtatagacatcaggggtctggcaccaggggtcccttccaatatcagcaccatggcctggactcctctctttctgttcctcctcacttgctgcccagggtccaattcccaggctgtggtgactcaggaaccctcactgagtgtgtccccaggggggacagtcattctcacctgtgcctccagcactggagaagtgaccagcggccactatccctactggttccaggtgaagtctggccaggcccccaggacactaatttatgatgcgaccaacagacactcctgggcgcctggccgtttttcgggctccctcctcgggggcaaagctgccctgaccctaacggggcgcagcctgaggacgaggccgactattattgcctactatcatttgatggtggtcgtctgcccattttcggcggcggaccagggtggccgtcctgggtcagcccaaggctgcccctcggtcactctgttcccaccctcctcctagtctacg

SEQ ID NO: 583361 - DNA, 494 bp, Homo sapiens; identical to SEQ ID NO: 534992
  misc_feature: HIJSMM301AOBIS.9.1.A01.1.454.light.4.raw

SEQ ID NO: 583362 - DNA, 507 bp, Homo sapiens
  misc_feature: HIJSMM301ESB3S.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggcaggacaaggtggaagtcaagcgaactgtggctgcaccatctgtcttcatcttcccgccact

SEQ ID NO: 583363 - DNA, 513 bp, Homo sapiens
  misc_feature: HIJSMM301DH24B.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaacggtggaagtcaagcgaactgtggctgcaccatctgtcttcatcttcccgtccact

SEQ ID NO: 583364 - DNA, 488 bp, Homo sapiens; identical to SEQ ID NO: 535725
  misc_feature: HIJSMM301AXYPG.12.88.H11.1.454.light.4.raw

SEQ ID NO: 583365 - DNA, 504 bp, Homo sapiens; identical to SEQ ID NO: 536385
  misc_feature: HIJSMM301A74OD.27.78.H01.1.454.light.4.raw

SEQ ID NO: 583366 - DNA, 507 bp, Homo sapiens
  misc_feature: HIJSMM301B1QB7.5.68.G02.1.454.light.4.raw
atcagacacgcacgaccggtgctcgatttagtcgatagtgaagggaaagggcaggacgtcaccaccatggcctgggctctgctcctcctcaccctcctcactcagggcacagggtcctgggcccactctgccctgactcagcctccctccgcgtccgggtctcctggacagtcagtcaccatctcctgcactggaaccagcagtgacgaagatttttataagtatgtctcctggtaccaacaacgcccaggcaaagcccccaagctcatgatttatgaggtcattaagcggccctcaggggtccctcatcgcttctctggctccaagtctggcaacacggcctccctgaccgtctctgggctccaggctgaggatgaggctacttattactgcagttcatatgcagacagcaacaatttcatattcggcggagggaccaggctgaccgtcctgggtcagcccaaggctcgccccctcggtcactctcgttcccgccctcctccgtgt

SEQ ID NO: 583367 - DNA, 488 bp, Homo sapiens; identical to SEQ ID NO: 537124
  misc_feature: HIJSMM301E02CO.11.25.C03.1.454.light.4.raw

SEQ ID NO: 583368 - DNA, 484 bp, Homo sapiens; identical to SEQ ID NO: 535400
  misc_feature: HIJSMM301ANKYF.46.26.C04.1.454.light.4.raw

SEQ ID NO: 583369 - DNA, 502 bp, Homo sapiens; identical to SEQ ID NO: 545020
  misc_feature: HIJSMM301A63SX.18.11.A11.1.454.light.4.raw

SEQ ID NO: 583370 - DNA, 483 bp, Homo sapiens
  misc_feature: HIJSMM301DN615.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccaaggtggaaatacaaacgaactagtggctgcaccta

SEQ ID NO: 583371 - DNA, 506 bp, Homo sapiens
  misc_feature: HIJSMM301C2AOO.48.7.A07.1.454.light.4.raw
agtatacatacacgaccggtgctcgatttagcacgtgtcgcaagagagagggggagagctgctcagttaggacccagagggaaccatggaaaccccagcgcagcttctcttcctcctgctactctggctcccagacaccaccggagaaattgtgttgacgcagtctccaggcaccctgtctttgtctccaggggaaagcgccaccctctcctgtagggccagtcagaatgttaagagccactccttagcctggtaccagcaaaaacctggccagcctcccaggctcctcatctatggtgcgtccaccagggccactggcatcccagacaggttcagtggcagtgggtctgggacagacttcactctcaccatcaccagactggagcctgatgattttgcagtgttttctgttcagcagtatggaagttcacctcggacattcggccaggggaccaaggtggaaatcaaacgaactgtggctgcaccatctgtcttcatcttccccg

SEQ ID NO: 583372 - DNA, 514 bp, Homo sapiens
  misc_feature: HIJSMM301CKJG9.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcattccgggggttttcggcggagggaccaagctgaccgtcctaggtcagcccaaggctgccccctcggtcactctgttcccg

SEQ ID NO: 583373 - DNA, 482 bp, Homo sapiens; identical to SEQ ID NO: 537424
  misc_feature: HIJSMM301A6E5X.4.39.D06.1.454.light.4.raw

SEQ ID NO: 583374 - DNA, 487 bp, Homo sapiens
  misc_feature: HIJSMM301C4HT4.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgtacttaccgtcgtacgtcaccg

SEQ ID NO: 583375 - DNA, 477 bp, Homo sapiens; identical to SEQ ID NO: 575458
  misc_feature: HIJSMM301BZCII.13.76.G10.1.454.light.4.raw

SEQ ID NO: 583376 - DNA, 508 bp, Homo sapiens
  misc_feature: HIJSMM301BBGAK.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgctgctcttgggcaactactgtcgtttgggtgttcggcggagggaccaagttgaccgtcctaggtcagcccaaggctgccccctcggtcactctcg

SEQ ID NO: 583377 - DNA, 443 bp, Homo sapiens; identical to SEQ ID NO: 559200
  misc_feature: HIJSMM301DYOML.5.9.A09.1.454.light.4.raw

SEQ ID NO: 583378 - DNA, 495 bp, Homo sapiens
  misc_feature: HIJSMM301CQBZ3.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccaagctggagatcaaccgaactgtggctgcaccatctgt

SEQ ID NO: 583379 - DNA, 500 bp, Homo sapiens; identical to SEQ ID NO: 550395
  misc_feature: HIJSMM301EXUDY.15.56.F01.1.454.light.4.raw

SEQ ID NO: 583380 - DNA, 492 bp, Homo sapiens
  misc_feature: HIJSMM301DN6V4.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggaggaccaaggtggaggtcaaacgaactgtggctgcaccatctgtcttcattcc

SEQ ID NO: 583381 - DNA, 499 bp, Homo sapiens
  misc_feature: HIJSMM301AMXAE.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcgttcggcgggagggacgaagctgaccgtcctgagtcgagcccaaggctcgccccctcggtcact

SEQ ID NO: 583382 - DNA, 478 bp, Homo sapiens
  misc_feature: HIJSMM301AR6LD.12.1.A01.1.454.light.4.raw
atacgacgtacacgaccggtgctcgatttagacgtctcatcagggggcgaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggcggagggaccaaggtggagatcaaacgaactgtggctgca

SEQ ID NO: 583383 - DNA, 491 bp, Homo sapiens; identical to SEQ ID NO: 542310
  misc_feature: HIJSMM301CHYLH.22.65.F10.1.454.light.4.raw

SEQ ID NO: 583384 - DNA, 499 bp, Homo sapiens
  misc_feature: HIJSMM301DNZRY.52.36.D03.1.454.light.4.raw
cgcagtacgacacgaccggtgctcgatttagctgcgtcacgatctctcttggggtgtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtctggggatgaggacacattggtgttcggcggagggaccaagctgaccgtcctacgtcagcccaaggctgccccctcggtcactctcg

SEQ ID NO: 583385 - DNA, 486 bp, Homo sapiens
  misc_feature: HIJSMM301EKSIZ.14.11.A11.1.454.light.4.raw
cgtctagtaccacgaccggtgctcgatttagctacgactgcagggggcaggagtcagacccactcaggacacagcatggacatgagggtccccgctcagctcctggggctcctgctgctctggctcccaggtgccagatgtgccatccaagtgacccagtctccatcctccctgtctgcatctgtaggagacagagtcaccatcacttgccgggcaagtcagttcattagaaatgagttaggctggtatcagcagaaaccagggaaagcccctaagctcctgatctatgctgcgtccaatttacaaactggggtcccatcaaggttcagcggcagtggatctggcacagatttcactctcaccatcagcagcctgcagcctgaagattttgcaacttattactgtctacaagattacaattaccctcgaacgttcggccaagggaccgaaggtggaagtacaaacgaactacgtggctgcaccata

SEQ ID NO: 583386 - DNA, 498 bp, Homo sapiens; identical to SEQ ID NO: 544540
  misc_feature: HIJSMM301B23NN.41.20.B09.1.454.light.4.raw

SEQ ID NO: 583387 - DNA, 507 bp, Homo sapiens; identical to SEQ ID NO: 560339
  misc_feature: HIJSMM301AK41Q.47.83.H06.1.454.light.4.raw

SEQ ID NO: 583388 - DNA, 493 bp, Homo sapiens
  misc_feature: HIJSMM301CZIFG.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccaggcaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacgactggaggttaacgaactgtggctgcaccatctgtcttcatcttcccgccat

SEQ ID NO: 583389 - DNA, 495 bp, Homo sapiens; identical to SEQ ID NO: 553683
  misc_feature: HIJSMM301DID6D.48.1.A01.1.454.light.4.raw

SEQ ID NO: 583390 - DNA, 500 bp, Homo sapiens
  misc_feature: HIJSMM301EV1NO.51.23.C01.1.454.light.4.raw
cgatcgtatacacgaccggtgctcgatttagtacacgtgattagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacgggtcacattggccatcagtggagtccaggcagaggacgaggctgactattattgtcaatcaacagacaccattggtacttatgtcttcggaactgcgaccaaggtcaccgtcctgggtcaggcccaaggccaacccccactgtcactt

SEQ ID NO: 583391 - DNA, 501 bp, Homo sapiens; identical to SEQ ID NO: 535746
  misc_feature: HIJSMM301DM2CZ.18.11.A11.1.454.light.4.raw

SEQ ID NO: 583392 - DNA, 484 bp, Homo sapiens; identical to SEQ ID NO: 535240
  misc_feature: HIJSMM301BG0KF.47.60.F05.1.454.light.4.raw

SEQ ID NO: 583393 - DNA, 496 bp, Homo sapiens
  misc_feature: HIJSMM301BQN0Z.17.29.C07.1.454.light.4.raw
cgtagactagcacgaccggtgctcgatttagagtgctacgaagggaaaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcgtgggaccaagctgaccgtctaggtcagcccaaggctgccccc

SEQ ID NO: 583394 - DNA, 496 bp, Homo sapiens; identical to SEQ ID NO: 535109
  misc_feature: HIJSMM301DSQ8R.16.78.H01.1.454.light.4.raw

SEQ ID NO: 583395 - DNA, 502 bp, Homo sapiens
  misc_feature: HIJSMM301DCRZR.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaacgccagggtcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatcacctttcggccaggggacacggcctggagatttaaacgaactgtggctgcacc

SEQ ID NO: 583396 - DNA, 352 bp, Homo sapiens
  misc_feature: HIJSMM301CI2W0.3.11.A11.1.454.light.4.raw
agacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgcatctgagagtgcgtct

SEQ ID NO: 583397 - DNA, 478 bp, Homo sapiens; identical to SEQ ID NO: 549111
  misc_feature: HIJSMM301AEJS7.16.86.H09.1.454.light.4.raw

SEQ ID NO: 583398 - DNA, 484 bp, Homo sapiens; identical to SEQ ID NO: 535211
  misc_feature: HIJSMM301A2NYI.47.46.E02.1.454.light.4.raw

SEQ ID NO: 583399 - DNA, 504 bp, Homo sapiens
  misc_feature: HIJSMM301AFTXA.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactagtggctgcaccatctgtcttcattttcccg

SEQ ID NO: 583400 - DNA, 474 bp, Homo sapiens; identical to SEQ ID NO: 576829
  misc_feature: HIJSMM301CW94R.40.23.C01.1.454.light.4.raw

SEQ ID NO: 583401 - DNA, 472 bp, Homo sapiens
  misc_feature: HIJSMM301CEDYK.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagttcactacccctctcactttcggcggggggaccgaaggtggagatcaacgaa

SEQ ID NO: 583402 - DNA, 494 bp, Homo sapiens; identical to SEQ ID NO: 534994
  misc_feature: HIJSMM301DKJ3N.27.78.H01.1.454.light.4.raw

SEQ ID NO: 583403 - DNA, 483 bp, Homo sapiens
  misc_feature: HIJSMM301BUNKU.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttatactgccagcagtataatgattaccctatcaccttcggccggggacacggctggaaactaaacgaactgtggctgcacc

SEQ ID NO: 583404 - DNA, 486 bp, Homo sapiens
  misc_feature: HIJSMM301EWU5I.49.14.B03.1.454.light.4.raw
agtcgagagacacgaccggtgctcgatttagtgtgagtagttccgcggggagtcccaaccaggacacagcatggacatgagggtccctgctcagctcctggggctcctgctgctctgactctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtcttcta

SEQ ID NO: 583405 - DNA, 508 bp, Homo sapiens; identical to SEQ ID NO: 536062
  misc_feature: HIJSMM301DHPSB.11.57.F02.1.454.light.4.raw

SEQ ID NO: 583406 - DNA, 502 bp, Homo sapiens; identical to SEQ ID NO: 536253
  misc_feature: HIJSMM301DMDXI.21.22.B11.1.454.light.4.raw

SEQ ID NO: 583407 - DNA, 496 bp, Homo sapiens
  misc_feature: HIJSMM301A6EF8.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcgccgaagggaccaaagtaggacgatcaagcgaactagtggctgcaccaactctgtt

SEQ ID NO: 583408 - DNA, 498 bp, Homo sapiens
  misc_feature: HIJSMM301B6PD0.52.35.D02.1.454.light.4.raw
cgcagtacgacacgaccggtgctcgatttagcacacgatagttgggtttgggggaagagctgctcagttaggacccagagggaaccatggaaaccccagcgcagcttctcttcctcctgctactctggctcccagatatcaccggagaaattgtgttgacgcagtctccaggcaccctgtctctgtctccaggggagagagccaccctctcctgcaggaccagtcagagtattagcaacagttacttagcctggtaccagcagaatcctggccaggctcccaggctcctcatctatggtgcgtccagcagggccactggcatcccagacaggttcagtggcaggtgggtctgggacagacttcactctcaccatcagcgagggtggagcctgaggtatttgcagtgtattattgtcagcactatggtaggtcacagtactacgttttggccgaggggaccaagcgtcggagatacaaacgaactgtggctcgcaccta

SEQ ID NO: 583409 - DNA, 481 bp, Homo sapiens
  misc_feature: HIJSMM301BWTSF.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagttttcccgctcactttcggcggagggaccaaggtggagagtcaaacgaactgtggctgca

SEQ ID NO: 583410 - DNA, 494 bp, Homo sapiens; identical to SEQ ID NO: 539894
  misc_feature: HIJSMM301BYFNA.16.53.E09.1.454.light.4.raw

SEQ ID NO: 583411 - DNA, 504 bp, Homo sapiens; identical to SEQ ID NO: 549053
  misc_feature: HIJSMM301DIOUS.4.71.G05.1.454.light.4.raw

SEQ ID NO: 583412 - DNA, 496 bp, Homo sapiens; identical to SEQ ID NO: 537925
  misc_feature: HIJSMM301C0TWQ.22.14.B03.1.454.light.4.raw

SEQ ID NO: 583413 - DNA, 482 bp, Homo sapiens; identical to SEQ ID NO: 535216
  misc_feature: HIJSMM301AWRVD.17.26.C04.1.454.light.4.raw

SEQ ID NO: 583414 - DNA, 484 bp, Homo sapiens; identical to SEQ ID NO: 540581
  misc_feature: HIJSMM301BQL3A.3.88.H11.1.454.light.4.raw

SEQ ID NO: 583415 - DNA, 496 bp, Homo sapiens
  misc_feature: HIJSMM301EAL63.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaaggtggaggatcaaacgaaactgtggctgcaccat

SEQ ID NO: 583416 - DNA, 491 bp, Homo sapiens
  misc_feature: HIJSMM301E3IJO.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccaacagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtgg

SEQ ID NO: 583417 - DNA, 506 bp, Homo sapiens
  misc_feature: HIJSMM301BRU8W.10.29.C07.1.454.light.4.raw
catagtagtgcacgaccggtgctcgatttagagtgctacgaagggaaagggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctcgccccctcggtcta

SEQ ID NO: 583418 - DNA, 506 bp, Homo sapiens
  misc_feature: HIJSMM301C9G39.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggccgaagggaccgaaggtggaaatcaaacgaactgtggctgcaccatctgtcttctatcttccccg

SEQ ID NO: 583419 - DNA, 499 bp, Homo sapiens
  misc_feature: HIJSMM301CTA2R.17.86.H09.1.454.light.4.raw
cgtagactagcacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactgtaaccagcagtgaccttagtgcttataactatgtctcctggtaccaacagcacccaggcaaggtccccaaagccatgatttatgaggtcagtaatcggccctcaggggtttctaatcgcttctctggctccaagtctggcaacacggcctccctcaccatctctggactccagcctgaggacgaggctgattattactgcatctcatttgtaagcagtagccttgtgttattcggcggagggaccaagctgaccgtcctggtcagcccaaggctgcccccg

SEQ ID NO: 583420 - DNA, 504 bp, Homo sapiens; identical to SEQ ID NO: 535561
  misc_feature: HIJSMM301BM1JM.4.57.F02.1.454.light.4.raw

SEQ ID NO: 583421 - DNA, 514 bp, Homo sapiens; identical to SEQ ID NO: 545875
  misc_feature: HIJSMM301AD00B.17.37.D04.1.454.light.4.raw

SEQ ID NO: 583422 - DNA, 488 bp, Homo sapiens
  misc_feature: HIJSMM301ETG4G.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagtggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcacat

SEQ ID NO: 583423 - DNA, 499 bp, Homo sapiens
  misc_feature: HIJSMM301CPM5G.41.35.D02.1.454.light.4.raw
tctatactatcacgaccggtgctcgatttagcacacgatagttgggtttgggggctttgcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggtcactctgttcccgccctcctcatagtataga

SEQ ID NO: 583424 - DNA, 501 bp, Homo sapiens
  misc_feature: HIJSMM301BJGCW.16.6.A06.1.454.light.4.raw
  modified_base (488)..(488): a, c, t, g, unknown or other
tgtactactccacgaccggtgctcgatttagatctactgacgagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtcgtgggacagatttcactctcaccatcagcagcctgcaggttgaagatgtggcagtttattactgtcagcagtattatactactcctctgacgttcggccaagggaccaaggtggagatcaaacgaactgtggntgcaccatcttcg

SEQ ID NO: 583425 - DNA, 447 bp, Homo sapiens; identical to SEQ ID NO: 535020
  misc_feature: HIJSMM301D72OE.18.9.A09.1.454.light.4.raw

SEQ ID NO: 583426 - DNA, 479 bp, Homo sapiens; identical to SEQ ID NO: 537163
  misc_feature: HIJSMM301EBZN6.13.73.G07.1.454.light.4.raw

SEQ ID NO: 583427 - DNA, 519 bp, Homo sapiens
  misc_feature: HIJSMM301B1PZD.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacggaccgaacggtaggaaggtacaaacgaactagtggcgtgcaccactctgtcttctactcttcccgtccact

SEQ ID NO: 583428 - DNA, 490 bp, Homo sapiens
  misc_feature: HIJSMM301DZ9X6.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacacgtacccccctcacctttcggcggagggaccaaggcggagatcagacgaactgtggctgcacatctgtctcta

SEQ ID NO: 583429 - DNA, 515 bp, Homo sapiens
  misc_feature: HIJSMM301A4Q58.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggccaaccccactgtcactctgttcccaccctcctcgac

SEQ ID NO: 583430 - DNA, 479 bp, Homo sapiens
  misc_feature: HIJSMM301AUVI2.4.10.A10.1.454.light.4.raw
agcactgtagcacgaccggtgctcgatttagcgtcgatctcaggggagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggagatcaaacgaactgtggctgcaccatctgtctt

SEQ ID NO: 583431 - DNA, 518 bp, Homo sapiens
  misc_feature: HIJSMM301A2HNR.41.19.B08.1.454.light.4.raw
  modified_base (512)..(512): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcagggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccncctcct

SEQ ID NO: 583432 - DNA, 479 bp, Homo sapiens; identical to SEQ ID NO: 540569
  misc_feature: HIJSMM301BIKO5.5.70.G04.1.454.light.4.raw

SEQ ID NO: 583433 - DNA, 485 bp, Homo sapiens
  misc_feature: HIJSMM301BJZPS.49.81.H04.1.454.light.4.raw
agtcgagagacacgaccggtgctcgatttagtagtgtagattcgcgggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgtt

SEQ ID NO: 583434 - DNA, 491 bp, Homo sapiens; identical to SEQ ID NO: 546499
  misc_feature: HIJSMM301CK0B8.48.35.D02.1.454.light.4.raw

SEQ ID NO: 583435 - DNA, 524 bp, Homo sapiens; identical to SEQ ID NO: 553799
  misc_feature: HIJSMM301EZBR0.40.27.C05.1.454.light.4.raw

SEQ ID NO: 583436 - DNA, 447 bp, Homo sapiens; identical to SEQ ID NO: 535201
  misc_feature: HIJSMM301AXRUQ.18.9.A09.1.454.light.4.raw

SEQ ID NO: 583437 - DNA, 497 bp, Homo sapiens
  misc_feature: HIJSMM301ELBAD.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccaatctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaagg

SEQ ID NO: 583438 - DNA, 486 bp, Homo sapiens
  misc_feature: HIJSMM301AWHN2.51.41.D08.1.454.light.4.raw
cgatcgtatacacgaccggtgctcgatttagtcacgcgagaaagggaaagggggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggtcggagggaccgaaaggtggagagtcaaacgaactagtggctgcaa

SEQ ID NO: 583439 - DNA, 503 bp, Homo sapiens; identical to SEQ ID NO: 536834
  misc_feature: HIJSMM301BE6JJ.2.35.D02.1.454.light.4.raw

SEQ ID NO: 583440 - DNA, 511 bp, Homo sapiens
  misc_feature: HIJSMM301DISNR.11.57.F02.1.454.light.4.raw
cgagagataccacgaccggtgctcgatttagctcgatatagttgggtttgggggaggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgaactgtggctgcaccatctgtcttcatcttcccgccta

SEQ ID NO: 583441 - DNA, 441 bp, Homo sapiens; identical to SEQ ID NO: 534971
  misc_feature: HIJSMM301DYFA7.11.3.A03.1.454.light.4.raw

SEQ ID NO: 583442 - DNA, 503 bp, Homo sapiens; identical to SEQ ID NO: 551912
  misc_feature: HIJSMM301BGPOW.12.50.E06.1.454.light.4.raw

SEQ ID NO: 583443 - DNA, 515 bp, Homo sapiens; identical to SEQ ID NO: 543484
  misc_feature: HIJSMM301BKFQH.14.19.B08.1.454.light.4.raw

SEQ ID NO: 583444 - DNA, 500 bp, Homo sapiens; identical to SEQ ID NO: 540219
  misc_feature: HIJSMM301DABQA.43.34.D01.1.454.light.4.raw

SEQ ID NO: 583445 - DNA, 489 bp, Homo sapiens; identical to SEQ ID NO: 536013
  misc_feature: HIJSMM301DN5HH.26.23.C01.1.454.light.4.raw

SEQ ID NO: 583446 - DNA, 479 bp, Homo sapiens
  misc_feature: HIJSMM301CYBC7.8.53.E09.1.454.light.4.raw
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctcctggtcatatctggtctccagggtgaggatgaggctgattattactgccactcctatgacaacagcctgagtatttggctgttcggcggtcgggacc

SEQ ID NO: 583447 - DNA, 484 bp, Homo sapiens
  misc_feature: HIJSMM301CDPWF.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctggaccaaagtggatatcaacgaactgtggctgcaccatctgtt

SEQ ID NO: 583448 - DNA, 493 bp, Homo sapiens; identical to SEQ ID NO: 537239
  misc_feature: HIJSMM301AGKRQ.49.66.F11.1.454.light.4.raw

SEQ ID NO: 583449 - DNA, 514 bp, Homo sapiens; identical to SEQ ID NO: 541418
  misc_feature: HIJSMM301E25LU.17.33.C11.1.454.light.4.raw

SEQ ID NO: 583450 - DNA, 493 bp, Homo sapiens; identical to SEQ ID NO: 536471
  misc_feature: HIJSMM301C9QXD.3.71.G05.1.454.light.4.raw

SEQ ID NO: 583451 - DNA, 520 bp, Homo sapiens; identical to SEQ ID NO: 562605
  misc_feature: HIJSMM301ESWQC.27.23.C01.1.454.light.4.raw
  modified_base (517)..(517): a, c, t, g, unknown or other

SEQ ID NO: 583452 - DNA, 487 bp, Homo sapiens
  misc_feature: HIJSMM301BZNLR.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaaggtcaagcgaactgtggctgcacca

SEQ ID NO: 583453 - DNA, 488 bp, Homo sapiens
  misc_feature: HIJSMM301DG4TG.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccaaggtggagagtcaaacgaactgt

SEQ ID NO: 583454 - DNA, 502 bp, Homo sapiens; identical to SEQ ID NO: 543936
  misc_feature: HIJSMM301A4V9U.15.1.A01.1.454.light.4.raw

SEQ ID NO: 583455 - DNA, 512 bp, Homo sapiens
  misc_feature: HIJSMM301C4OSC.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaaacaataacaactacttagcttggtaccagcagaaaccaggacagccccctaaggtcctcatttactgggcatctacccgggagtccggggtccctgaccgattcagaggcaggcgggtctgggacagatttcactctcaccatcaccaacctgcaggctgaagatgtggcagttttattactgtcagcaaatactatagtcctcctctctacggttcggcgggagggaccaagggtggaagatacaaacgaactgtggctgccaccatctgtctt

SEQ ID NO: 583456 - DNA, 512 bp, Homo sapiens; identical to SEQ ID NO: 536721
  misc_feature: HIJSMM301CXCWS.14.70.G04.1.454.light.4.raw

SEQ ID NO: 583457 - DNA, 516 bp, Homo sapiens
  misc_feature: HIJSMM301DGGC4.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccacctcct

SEQ ID NO: 583458 - DNA, 497 bp, Homo sapiens
  misc_feature: HIJSMM301AVNWG.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaggggccactggcatcccagccaggttcagtggcagtgggtctggaagagacttcactctcaccatcaacagcctagagcctgacgattctgcagtttattactgtcagcagcgtaccaagtggcctccgacttttggccagggggccaagctggagatcagacgaactgtggctgcaccatctgtcttcatcttccccg

SEQ ID NO: 583459 - DNA, 498 bp, Homo sapiens; identical to SEQ ID NO: 549310
  misc_feature: HIJSMM301B9PKM.12.86.H09.1.454.light.4.raw

SEQ ID NO: 583460 - DNA, 487 bp, Homo sapiens; identical to SEQ ID NO: 535863
  misc_feature: HIJSMM301DZ9FZ.19.71.G05.1.454.light.4.raw

SEQ ID NO: 583461 - DNA, 521 bp, Homo sapiens; identical to SEQ ID NO: 538715
  misc_feature: HIJSMM301AGBF9.27.23.C01.1.454.light.4.raw

SEQ ID NO: 583462 - DNA, 489 bp, Homo sapiens
  misc_feature: HIJSMM301AS95C.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtaccccctcactttcggcggagggaccaaggcggagatcagacgaactgtggctgcaccatctgtcttcta

SEQ ID NO: 583463 - DNA, 503 bp, Homo sapiens; identical to SEQ ID NO: 548067
  misc_feature: HIJSMM301DMCNS.9.53.E09.1.454.light.4.raw

SEQ ID NO: 583464 - DNA, 489 bp, Homo sapiens; identical to SEQ ID NO: 562972
  misc_feature: HIJSMM301CKUTL.51.28.C06.1.454.light.4.raw

SEQ ID NO: 583465 - DNA, 505 bp, Homo sapiens; identical to SEQ ID NO: 536254
  misc_feature: HIJSMM301D7USY.7.71.G05.1.454.light.4.raw

SEQ ID NO: 583466 - DNA, 479 bp, Homo sapiens; identical to SEQ ID NO: 573236
  misc_feature: HIJSMM301CGJMK.11.11.A11.1.454.light.4.raw

SEQ ID NO: 583467 - DNA, 500 bp, Homo sapiens; identical to SEQ ID NO: 535310
  misc_feature: HIJSMM301D32L0.47.66.F11.1.454.light.4.raw

SEQ ID NO: 583468 - DNA, 510 bp, Homo sapiens
  misc_feature: HIJSMM301E3CK8.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccgccct

SEQ ID NO: 583469 - DNA, 486 bp, Homo sapiens
  misc_feature: HIJSMM301CEB1T.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcgagggaccaaggttgagatcaaacgaactgtggctgcacc

SEQ ID NO: 583470 - DNA, 485 bp, Homo sapiens; identical to SEQ ID NO: 536040
  misc_feature: HIJSMM301BYVGL.15.1.A01.1.454.light.4.raw

SEQ ID NO: 583471 - DNA, 503 bp, Homo sapiens; identical to SEQ ID NO: 559148
  misc_feature: HIJSMM301EFQ29.7.31.C09.1.454.light.4.raw

SEQ ID NO: 583472 - DNA, 496 bp, Homo sapiens
  misc_feature: HIJSMM301BULSE.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggccccatcaaggttcagtggcagtggctctgggacagatttcactctcaccatcagcagtctccaacctgaagattttgcaacttactactgtcaacagagtttcagtagtccccggacgttcggtccaagggaccaaggtggacgatcaaacgaacctagtggctgcacactctgtcttt

SEQ ID NO: 583473 - DNA, 497 bp, Homo sapiens
  misc_feature: HIJSMM301A8NW7.51.33.C11.1.454.light.4.raw
cgatcgtatacacgaccggtgctcgatttagagtgagctcgttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctcgcccctcggtcactcg

SEQ ID NO: 583474 - DNA, 421 bp, Homo sapiens; identical to SEQ ID NO: 537892
  misc_feature: HIJSMM301A9UUN.41.15.B04.1.454.light.4.raw

SEQ ID NO: 583475 - DNA, 495 bp, Homo sapiens; identical to SEQ ID NO: 535007
  misc_feature: HIJSMM301COZ1G.22.5.A05.1.454.light.4.raw

SEQ ID NO: 583476 - DNA, 494 bp, Homo sapiens; identical to SEQ ID NO: 535276
  misc_feature: HIJSMM301B2EJG.16.6.A06.1.454.light.4.raw

SEQ ID NO: 583477 - DNA, 484 bp, Homo sapiens
  misc_feature: HIJSMM301C6BKT.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccgaagtggagatcaaacgaa

SEQ ID NO: 583478 - DNA, 495 bp, Homo sapiens; identical to SEQ ID NO: 535712
  misc_feature: HIJSMM301ADBNR.27.78.H01.1.454.light.4.raw

SEQ ID NO: 583479 - DNA, 484 bp, Homo sapiens; identical to SEQ ID NO: 537427
  misc_feature: HIJSMM301APRU9.26.78.H01.1.454.light.4.raw

SEQ ID NO: 583480 - DNA, 498 bp, Homo sapiens
  misc_feature: HIJSMM301B1DXZ.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcatcttcccg

SEQ ID NO: 583481 - DNA, 517 bp, Homo sapiens; identical to SEQ ID NO: 536980
  misc_feature: HIJSMM301DZI6O.5.27.C05.1.454.light.4.raw

SEQ ID NO: 583482 - DNA, 503 bp, Homo sapiens; identical to SEQ ID NO: 536834
  misc_feature: HIJSMM301B7H0A.2.35.D02.1.454.light.4.raw

SEQ ID NO: 583483 - DNA, 506 bp, Homo sapiens; identical to SEQ ID NO: 534969
  misc_feature: HIJSMM301DGO0Y.18.37.D04.1.454.light.4.raw

SEQ ID NO: 583484 - DNA, 493 bp, Homo sapiens
  misc_feature: HIJSMM301DIRDO.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaaggtggaaagtacaaacgaacgtacgtggctgcacc

SEQ ID NO: 583485 - DNA, 502 bp, Homo sapiens
  misc_feature: HIJSMM301BS88F.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaaacgaactgtggctgcaccatctgt

SEQ ID NO: 583486 - DNA, 504 bp, Homo sapiens
  misc_feature: HIJSMM301CPTT1.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggataaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcggggggaccaaggtggagttcaaacgaactgtggctgcaccatctgtcttcatcttcccgccta

SEQ ID NO: 583487 - DNA, 454 bp, Homo sapiens; identical to SEQ ID NO: 535005
  misc_feature: HIJSMM301A6ZWP.19.86.H09.1.454.light.4.raw

SEQ ID NO: 583488 - DNA, 488 bp, Homo sapiens
  misc_feature: HIJSMM301AT7IC.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggacttcggcggagggacgaacggtaggagatacaaacgaa

SEQ ID NO: 583489 - DNA, 467 bp, Homo sapiens
  misc_feature: HIJSMM301DM81I.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctgtaggagacagagtcaccatcacttgccgggcaagtcagagcatcacctactatttaaattggtatcagcaaaacccagggaaagcccctaagctcctgatctatgctgcatccaatctgcaaagtgggtcccatcaaggttcagtggcagtggatctgggacagatttcaccctcaccatcagcagtctgcaacctgatgattttgcaacttattattgtcaacagagttacagtatcccgtacacttttggccaggggaccaggctggatatcagacgaa

SEQ ID NO: 583490 - DNA, 502 bp, Homo sapiens
  misc_feature: HIJSMM301AXY83.4.37.D04.1.454.light.4.raw
agcactgtagcacgaccggtgctcgatttagtagcatactgttgggtttgggggctttgcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaaggccaaccccactgtcactctgttcccaccctcctcctacatg

SEQ ID NO: 583491 - DNA, 484 bp, Homo sapiens; identical to SEQ ID NO: 535441
  misc_feature: HIJSMM301EGATO.26.60.F05.1.454.light.4.raw

SEQ ID NO: 583492 - DNA, 492 bp, Homo sapiens
  misc_feature: HIJSMM301D7JCY.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttggcccagggaccacagtggagatcaggcgaactgtggctgcaccatctgtctt

SEQ ID NO: 583493 - DNA, 488 bp, Homo sapiens
  misc_feature: HIJSMM301DNUOO.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatatatgttgcatccactttgcaaagtggggtcccatcaaggttcagcggcagtggatctgggacagaattcactctcacaatcagcagcctgcagcctgagattttgcaacttattactgtcaacagcttaatagttacccgctcagtttcggcggagggaccaaggtggagatcaaacgaactgtggctgcaccatctgtcttcta

SEQ ID NO: 583494 - DNA, 482 bp, Homo sapiens; identical to SEQ ID NO: 535352
  misc_feature: HIJSMM301BCIYJ.16.81.H04.1.454.light.4.raw

SEQ ID NO: 583495 - DNA, 486 bp, Homo sapiens; identical to SEQ ID NO: 535043
  misc_feature: HIJSMM301BN6T5.46.35.D02.1.454.light.4.raw

SEQ ID NO: 583496 - DNA, 494 bp, Homo sapiens; identical to SEQ ID NO: 539065
  misc_feature: HIJSMM301B2AVY.11.81.H04.1.454.light.4.raw

SEQ ID NO: 583497 - DNA, 493 bp, Homo sapiens
  misc_feature: HIJSMM301BKMWH.51.81.H04.1.454.light.4.raw
cgatcgtatacacgaccggtgctcgatttagtagtgtagattcgcggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 583498 - DNA, 503 bp, Homo sapiens
  misc_feature: HIJSMM301EPJ5I.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggccg

SEQ ID NO: 583499 - DNA, 505 bp, Homo sapiens; identical to SEQ ID NO: 556155
  misc_feature: HIJSMM301DFOEZ.19.78.H01.1.454.light.4.raw

SEQ ID NO: 583500 - DNA, 497 bp, Homo sapiens; identical to SEQ ID NO: 534982
  misc_feature: HIJSMM301EBH49.26.80.H03.1.454.light.4.raw

SEQ ID NO: 583501 - DNA, 479 bp, Homo sapiens; identical to SEQ ID NO: 537163
  misc_feature: HIJSMM301EOM1K.13.73.G07.1.454.light.4.raw

SEQ ID NO: 583502 - DNA, 444 bp, Homo sapiens
  misc_feature: HIJSMM301EGSV3.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtctgtcctatgacgacgacctacagactccggttttcggcggagggactaagctgaccgtcctaagtcagcccaaggctgccccctcggtcactctgttcccaccctcctcgtatctctcg

SEQ ID NO: 583503 - DNA, 502 bp, Homo sapiens; identical to SEQ ID NO: 539314
  misc_feature: HIJSMM301A4VLZ.21.81.H04.1.454.light.4.raw

SEQ ID NO: 583504 - DNA, 447 bp, Homo sapiens; identical to SEQ ID NO: 535201
  misc_feature: HIJSMM301CV0BG.18.9.A09.1.454.light.4.raw

SEQ ID NO: 583505 - DNA, 491 bp, Homo sapiens
  misc_feature: HIJSMM301APYEC.49.60.F05.1.454.light.4.raw
agtcgagagacacgaccggtgctcgatttagtacgtcatcagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 583506 - DNA, 444 bp, Homo sapiens; identical to SEQ ID NO: 535027
  misc_feature: HIJSMM301AWHXL.8.73.G07.1.454.light.4.raw

SEQ ID NO: 583507 - DNA, 509 bp, Homo sapiens; identical to SEQ ID NO: 545244
  misc_feature: HIJSMM301BCXFV.51.38.D05.1.454.light.4.raw

SEQ ID NO: 583508 - DNA, 500 bp, Homo sapiens
  misc_feature: HIJSMM301C8ND4.52.35.D02.1.454.light.4.raw
cgcagtacgacacgaccggtgctcgatttagcacacgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggtcaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 583509 - DNA, 521 bp, Homo sapiens; identical to SEQ ID NO: 538715
  misc_feature: HIJSMM301BX3IW.27.23.C01.1.454.light.4.raw

SEQ ID NO: 583510 - DNA, 491 bp, Homo sapiens
  misc_feature: HIJSMM301B7F1P.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactcttacacttttggccaggggaccaagctggagatcaaacgaactgtgg

SEQ ID NO: 583511 - DNA, 488 bp, Homo sapiens; identical to SEQ ID NO: 537260
  misc_feature: HIJSMM301DUY75.47.70.G04.1.454.light.4.raw

SEQ ID NO: 583512 - DNA, 494 bp, Homo sapiens
  misc_feature: HIJSMM301B4QAW.4.27.C05.1.454.light.4.raw
agcactgtagcacgaccggtgctcgatttagacgcgatcgaagggtttggggctgggcctcaggaagcagcatcggaggtgcctcagccatgacatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtcact

SEQ ID NO: 583513 - DNA, 503 bp, Homo sapiens
  misc_feature: HIJSMM301DM9UT.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactagtggctgcaccatctgtcttcatt

SEQ ID NO: 583514 - DNA, 509 bp, Homo sapiens; identical to SEQ ID NO: 541829
  misc_feature: HIJSMM301E0P5K.17.28.C06.1.454.light.4.raw

SEQ ID NO: 583515 - DNA, 488 bp, Homo sapiens
  misc_feature: HIJSMM301CEUYQ.49.10.A10.1.454.light.4.raw
agtcgagagacacgaccggtgctcgatttagcgtcgatctcagggcacgaccggtgctcgatttagtatcactcagtcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagtaac

SEQ ID NO: 583516 - DNA, 499 bp, Homo sapiens
  misc_feature: HIJSMM301BAUFK.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttatactgtcagcagcgtaacaattggccgatcaccttcggccaagggacacgactggagattaaacgaactgtggctgcaccatctgtcttcatcttcccgccat

SEQ ID NO: 583517 - DNA, 487 bp, Homo sapiens
  misc_feature: HIJSMM301DLDT4.46.35.D02.1.454.light.4.raw
actagcagtacacgaccggtgctcgatttagcacacgatagttgggtttgggggagctgctcagttaggacccagagggaaccatggaaaccccagcgcagcttctcttacctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 583518 - DNA, 487 bp, Homo sapiens
  misc_feature: HIJSMM301EAC3A.41.10.A10.1.454.light.4.raw
tctatactatcacgaccggtgctcgatttagcgtcgatctcagggggcatgagcaagactgacaagtcaaggcaggaagatgttgccatcacaactcattgggtttctgctgctctgggttccagcctccaggggtgaaattgtgctgactcagtctccaggctttcagtctgtgactccaaaggagaaagtcaccatcacctgccgggccagtcagagcattgatagtgatttacactggtaccagcagaaaccaaatcagtctccaaagctcctcatcaagtattcttcccagtccatctcaggggtcccctcgaggttcagtggcagtggatctgggacagatttcaccctcaccatcagtagcctggaagctgaagatgctgcaacgtattactgtcatcagagtcgtagtttacctcaaacgttcggccaagggaccaaggtggaaaatcaaacgaactgtggctgcaccatctgtcttcat

SEQ ID NO: 583519 - DNA, 514 bp, Homo sapiens
  misc_feature: HIJSMM301A35EW.40.53.E09.1.454.light.4.raw
tctagcgactcacgaccggtgctcgatttagagagagtgtgttgggtttgggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtggttcggcggggggaccgaaggctgaccgtcctaagtcagcccaaggctgccccctccggtcactcttcg

SEQ ID NO: 583520 - DNA, 453 bp, Homo sapiens; identical to SEQ ID NO: 535173
  misc_feature: HIJSMM301ESO8O.19.86.H09.1.454.light.4.raw

SEQ ID NO: 583521 - DNA, 485 bp, Homo sapiens; identical to SEQ ID NO: 535880
  misc_feature: HIJSMM301AWQJK.7.75.G09.1.454.light.4.raw

SEQ ID NO: 583522 - DNA, 512 bp, Homo sapiens
  misc_feature: HIJSMM301BIVI7.48.56.F01.1.454.light.4.raw
agtatacatacacgaccggtgctcgatttagcagacgtctgaacacacaaagggggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgccccctcggtccactctcg

SEQ ID NO: 583523 - DNA, 481 bp, Homo sapiens; identical to SEQ ID NO: 535993
  misc_feature: HIJSMM301CW9C7.21.25.C03.1.454.light.4.raw

SEQ ID NO: 583524 - DNA, 460 bp, Homo sapiens; identical to SEQ ID NO: 537107
  misc_feature: HIJSMM301BWZ16.22.28.C06.1.454.light.4.raw

SEQ ID NO: 583525 - DNA, 512 bp, Homo sapiens
  misc_feature: HIJSMM301AH5WX.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgtccgaacgggaccgaaggtaggaaagtacaaacgaaactagtggcgtgcaccactctgtcttcatcttccccg

SEQ ID NO: 583526 - DNA, 501 bp, Homo sapiens
  misc_feature: HIJSMM301DESQS.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaaatactatagtcctcctctcacgttcggcggagggaccaaggtggagatcaaacgaactgtgctgcaccatctgtctt

SEQ ID NO: 583527 - DNA, 504 bp, Homo sapiens; identical to SEQ ID NO: 581357
  misc_feature: HIJSMM301C9YD8.21.81.H04.1.454.light.4.raw

SEQ ID NO: 583528 - DNA, 498 bp, Homo sapiens
  misc_feature: HIJSMM301ERY6Q.40.55.E11.1.454.light.4.raw
tctagcgactcacgaccggtgctcgatttagcactcgcacgttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaaggctcg

SEQ ID NO: 583529 - DNA, 493 bp, Homo sapiens
  misc_feature: HIJSMM301C9NWW.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccaggggaccaagctggagatcaatcgaactgtggt

SEQ ID NO: 583530 - DNA, 501 bp, Homo sapiens; identical to SEQ ID NO: 536142
  misc_feature: HIJSMM301EP1CF.15.1.A01.1.454.light.4.raw

SEQ ID NO: 583531 - DNA, 530 bp, Homo sapiens
  misc_feature: HIJSMM301C756T.22.30.C08.1.454.light.4.raw
acatacgcgtcacgaccggtgctcgatttagtctgacgtcaaagggaaagggggagctctggggaggtctgcaccatggcgttggtaccccacctcctcttcctcaccctccctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccgggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctcgcccccctcggtcactctcgttcccgccctcctacacgtcg

SEQ ID NO: 583532 - DNA, 519 bp, Homo sapiens
  misc_feature: HIJSMM301BGQWO.22.30.C08.1.454.light.4.raw
  modified_base (508)..(508): a, c, t, g, unknown or other
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctcgccccctcggtcactctgttcccnccctcctcacg

SEQ ID NO: 583533 - DNA, 496 bp, Homo sapiens; identical to SEQ ID NO: 535109
  misc_feature: HIJSMM301DO5GZ.16.78.H01.1.454.light.4.raw

SEQ ID NO: 583534 - DNA, 454 bp, Homo sapiens; identical to SEQ ID NO: 536943
  misc_feature: HIJSMM301B41F0.19.86.H09.1.454.light.4.raw

SEQ ID NO: 583535 - DNA, 490 bp, Homo sapiens
  misc_feature: HIJSMM301EMLY6.5.45.E01.1.454.light.4.raw
atcagacacgcacgaccggtgctcgatttagtgagtcagtaagggaaagggggggcgacttctccctctaacactctccccgctcagctcctggggctcctgctgctctggttcccaggttccagatgcgacatccagatgacccagtctccttctttcgtgtctgcgtctgtaggagacagacttactatcgcttgtcgggcgagtcaggatattagtaccaggttagcctggtatcagcagaagcctgggagagcccctaaactcctgatctatgctgcatcaagtctgcaaagtggggtcccatcgaggttcagaggcagtggatctgggacagatttcactctcaccatcagcggcctgcagcctgaagattatgcaacttactattgtcaaagttctaatgctttcccgcgcacgtttggccaggggaccaaggtagagatcaaacgaactgtggctgcaccatctgtcttcatcttcccgccat

SEQ ID NO: 583536 - DNA, 515 bp, Homo sapiens
  misc_feature: HIJSMM301CJKB7.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtcttttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtcagcccaaggccg

SEQ ID NO: 583537 - DNA, 469 bp, Homo sapiens
  misc_feature: HIJSMM301C6W68.51.1.A01.1.454.light.4.raw
cgatcgtatacacgaccggtgctcgatttagacgtctcatcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacagggtcccatcaaggttcagtgcaagtggctctgggacagatttcactttcaccatcagcagactgcagcctgaagatattgcaacatattactgtcaacagtatgataatctcccgctcactttcggcggagggaccaaggtgggagtcaaacgaactgt

SEQ ID NO: 583538 - DNA, 483 bp, Homo sapiens; identical to SEQ ID NO: 541990
  misc_feature: HIJSMM301C5TGP.46.26.C04.1.454.light.4.raw

SEQ ID NO: 583539 - DNA, 494 bp, Homo sapiens; identical to SEQ ID NO: 535276
  misc_feature: HIJSMM301BC5OC.16.6.A06.1.454.light.4.raw

SEQ ID NO: 583540 - DNA, 488 bp, Homo sapiens
  misc_feature: HIJSMM301CCWMP.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattaactgtcaacagtatcataatctccccactttcggccctgggaccaaagtggatatcaaacgaactagtggctgcaccatctgtt

SEQ ID NO: 583541 - DNA, 503 bp, Homo sapiens
  misc_feature: HIJSMM301ERDYX.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggccccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcta

SEQ ID NO: 583542 - DNA, 495 bp, Homo sapiens
  misc_feature: HIJSMM301D4NTB.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggcctaggggaccaagctggagatcaaacgaactgtggctgcaccatctgtctt

SEQ ID NO: 583543 - DNA, 488 bp, Homo sapiens; identical to SEQ ID NO: 537260
  misc_feature: HIJSMM301B1PYB.47.70.G04.1.454.light.4.raw

SEQ ID NO: 583544 - DNA, 486 bp, Homo sapiens; identical to SEQ ID NO: 535043
  misc_feature: HIJSMM301CPDBM.46.35.D02.1.454.light.4.raw

SEQ ID NO: 583545 - DNA, 514 bp, Homo sapiens
  misc_feature: HIJSMM301C3Q23.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcggggcaaagctgccctgacactgtcaggtgtgcagcctgaggacgaggctgactattactgcctgctcatatatggtggcgcgtgggtgttcggcggagggaccaagctgaccgtcctggtcagcccaaggctgccccctcggtcactctgttcccaccctcctca

SEQ ID NO: 583546 - DNA, 495 bp, Homo sapiens
  misc_feature: HIJSMM301C8N8L.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacagggtcccatcaaggttcagtggaggtggatctgggacagattttactctcggcatccgcagcctgcagcctgaagattttgcgacatattactgttcaacagtatgaaaatgtcccgctcactttcggcgggggaccgaaggtggagttcaaacgaaactgtggctgcaccatctgtcttcat

SEQ ID NO: 583547 - DNA, 501 bp, Homo sapiens
  misc_feature: HIJSMM301BFEN1.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaaggctggagatcaaacgaactgtggctgcaccatctgtcttcatt

SEQ ID NO: 583548 - DNA, 507 bp, Homo sapiens; identical to SEQ ID NO: 577580
  misc_feature: HIJSMM301CI7J4.15.86.H09.1.454.light.4.raw

SEQ ID NO: 583549 - DNA, 482 bp, Homo sapiens
  misc_feature: HIJSMM301B0WRK.52.23.C01.1.454.light.4.raw
cgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggaggaccaaggtggagatcagacgaactgtggctgcaccat

SEQ ID NO: 583550 - DNA, 497 bp, Homo sapiens; identical to SEQ ID NO: 535286
  misc_feature: HIJSMM301AL7GE.18.59.F04.1.454.light.4.raw

SEQ ID NO: 583551 - DNA, 492 bp, Homo sapiens; identical to SEQ ID NO: 549170
  misc_feature: HIJSMM301EBRKG.40.81.H04.1.454.light.4.raw

SEQ ID NO: 583552 - DNA, 486 bp, Homo sapiens; identical to SEQ ID NO: 535458
  misc_feature: HIJSMM301CJQWU.7.75.G09.1.454.light.4.raw

SEQ ID NO: 583553 - DNA, 494 bp, Homo sapiens
  misc_feature: HIJSMM301ADO6U.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctcgggaccaaagtggagatcaaacgaactagtgg

SEQ ID NO: 583554 - DNA, 479 bp, Homo sapiens; identical to SEQ ID NO: 536050
  misc_feature: HIJSMM301BDLWL.5.73.G07.1.454.light.4.raw

SEQ ID NO: 583555 - DNA, 494 bp, Homo sapiens; identical to SEQ ID NO: 535629
  misc_feature: HIJSMM301EA0JH.4.27.C05.1.454.light.4.raw

SEQ ID NO: 583556 - DNA, 459 bp, Homo sapiens
  misc_feature: HIJSMM301D4F9G.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggagggaccaaggtggagatgaagggaactgtggctgcaccatctgtcttcatcttcccgccatctgaagtcgctaga

SEQ ID NO: 583557 - DNA, 495 bp, Homo sapiens
  misc_feature: HIJSMM301BCMQL.51.83.H06.1.454.light.4.raw
cgatcgtatacacgaccggtgctcgatttagatcacgtgcgtcgcggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaactgtggctgcaccatctgtcttcat

SEQ ID NO: 583558 - DNA, 488 bp, Homo sapiens
  misc_feature: HIJSMM301CZMOV.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtctaggtcagcccaaggccaacccactgtcactctgttcccacctcctctacgtgagct

SEQ ID NO: 583559 - DNA, 439 bp, Homo sapiens; identical to SEQ ID NO: 543309
  misc_feature: HIJSMM301C8FLK.11.3.A03.1.454.light.4.raw

SEQ ID NO: 583560 - DNA, 500 bp, Homo sapiens; identical to SEQ ID NO: 582365
  misc_feature: HIJSMM301CVOJ7.51.24.C02.1.454.light.4.raw

SEQ ID NO: 583561 - DNA, 454 bp, Homo sapiens; identical to SEQ ID NO: 536943
  misc_feature: HIJSMM301ESTNA.19.86.H09.1.454.light.4.raw

SEQ ID NO: 583562 - DNA, 505 bp, Homo sapiens
  misc_feature: HIJSMM301DNTS6.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaagtacaaacgaactagtggctgcaccatctgtcttcatcttccccg

SEQ ID NO: 583563 - DNA, 506 bp, Homo sapiens
  misc_feature: HIJSMM301CHTV4.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctgacaacacggcctccctgaccatctctgggctccaggctgaggacgaggctgattattactgcagcttatatacaggcaacaatacttttgtcttcggaactggacaggtcaccgtcctaggtcagcccaaggccaacccactgtcactctcg

SEQ ID NO: 583564 - DNA, 496 bp, Homo sapiens
  misc_feature: HIJSMM301DZESJ.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcacactctgt

SEQ ID NO: 583565 - DNA, 488 bp, Homo sapiens; identical to SEQ ID NO: 545628
  misc_feature: HIJSMM301DKXW4.14.55.E11.1.454.light.4.raw

SEQ ID NO: 583566 - DNA, 522 bp, Homo sapiens
  misc_feature: HIJSMM301BS750.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggcccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcgctaga

SEQ ID NO: 583567 - DNA, 497 bp, Homo sapiens; identical to SEQ ID NO: 575590
  misc_feature: HIJSMM301C2BCZ.52.78.H01.1.454.light.4.raw

SEQ ID NO: 583568 - DNA, 502 bp, Homo sapiens
  misc_feature: HIJSMM301DD6K5.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaaggaccgaacggtggaaagtcaagcgaactagtggctgcacactctgtcttcatcttccg

SEQ ID NO: 583569 - DNA, 497 bp, Homo sapiens; identical to SEQ ID NO: 549756
  misc_feature: HIJSMM301E0G3F.40.57.F02.1.454.light.4.raw

SEQ ID NO: 583570 - DNA, 441 bp, Homo sapiens; identical to SEQ ID NO: 535074
  misc_feature: HIJSMM301ATJKO.11.3.A03.1.454.light.4.raw

SEQ ID NO: 583571 - DNA, 503 bp, Homo sapiens
  misc_feature: HIJSMM301DO4O5.4.21.B10.1.454.light.4.raw
  modified_base (422)..(422): a, c, t, g, unknown or other
agcactgtagcacgaccggtgctcgatttagtgtcgtcgcaagagagagagaggagggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaataganaacagtgataatttctgggtgttcggcggagggaccaaactgaccgtctaggtcagcccaaggctgccccctcggtcactc

SEQ ID NO: 583572 - DNA, 447 bp, Homo sapiens; identical to SEQ ID NO: 535201
  misc_feature: HIJSMM301AN50G.18.9.A09.1.454.light.4.raw

SEQ ID NO: 583573 - DNA, 518 bp, Homo sapiens; identical to SEQ ID NO: 542842
  misc_feature: HIJSMM301AJ1HE.8.87.H10.1.454.light.4.raw

SEQ ID NO: 583574 - DNA, 488 bp, Homo sapiens; identical to SEQ ID NO: 535081
  misc_feature: HIJSMM301DS942.26.23.C01.1.454.light.4.raw

SEQ ID NO: 583575 - DNA, 488 bp, Homo sapiens
  misc_feature: HIJSMM301EE2RI.52.17.B06.1.454.light.4.raw
cgcagtacgacacgaccggtgctcgatttagtcgatagtgaagggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtggggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactcgtggctgcaccatctgt

SEQ ID NO: 583576 - DNA, 508 bp, Homo sapiens
  misc_feature: HIJSMM301A79X2.48.70.G04.1.454.light.4.raw
agtatacatacacgaccggtgctcgatttagtgtagtgtgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactcctcgggcgttcggtccaagggaccgaacggtggaaagtacaaacgaaacctagtggcgttgcgaccaa

SEQ ID NO: 583577 - DNA, 509 bp, Homo sapiens
  misc_feature: HIJSMM301BQYXP.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttacgtccgaacggaacgacgacgtagtaggataaaggtaaacgtagtggcgtgcaccaactctgtcttctactcttccccg

SEQ ID NO: 583578 - DNA, 492 bp, Homo sapiens; identical to SEQ ID NO: 535126
  misc_feature: HIJSMM301DBVQT.18.11.A11.1.454.light.4.raw

SEQ ID NO: 583579 - DNA, 501 bp, Homo sapiens
  misc_feature: HIJSMM301DXMX4.51.78.H01.1.454.light.4.raw
cgatcgtatacacgaccggtgctcgatttagtgtgagtagtttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacaggggaggctgcgattttcgggcggagggaccagtctgaccgtcctaggtcagcccaaggctgccccctcggtcactctcg

SEQ ID NO: 583580 - DNA, 505 bp, Homo sapiens
  misc_feature: HIJSMM301EDWGE.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaatcagcagggtggaggctgaggatgttggggtttattactgcatgcaaactacacacggccgctcactttcggcggagggaccaaggtggagatcaaacgaactgtggctgcaccatctgtt

SEQ ID NO: 583581 - DNA, 484 bp, Homo sapiens; identical to SEQ ID NO: 536162
  misc_feature: HIJSMM301AWNGZ.13.59.F04.1.454.light.4.raw

SEQ ID NO: 583582 - DNA, 487 bp, Homo sapiens; identical to SEQ ID NO: 555321
  misc_feature: HIJSMM301CE621.19.71.G05.1.454.light.4.raw

SEQ ID NO: 583583 - DNA, 494 bp, Homo sapiens
  misc_feature: HIJSMM301A7ZKP.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactgtggctgcaccatctgtcttcta

SEQ ID NO: 583584 - DNA, 459 bp, Homo sapiens
  misc_feature: HIJSMM301C6QPD.41.12.B01.1.454.light.4.raw
tctatactatcacgaccggtgctcgatttagtagtgtagattccgcgggcacgaccggtgctcgatttagtagtgtagattccgcggcacgaccggtgctcgatttagatagcttcgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 583585 - DNA, 494 bp, Homo sapiens; identical to SEQ ID NO: 536477
  misc_feature: HIJSMM301B65SN.22.5.A05.1.454.light.4.raw

SEQ ID NO: 583586 - DNA, 463 bp, Homo sapiens; identical to SEQ ID NO: 535008
  misc_feature: HIJSMM301D3J00.10.9.A09.1.454.light.4.raw

SEQ ID NO: 583587 - DNA, 483 bp, Homo sapiens; identical to SEQ ID NO: 535413
  misc_feature: HIJSMM301BKQ3S.26.78.H01.1.454.light.4.raw

SEQ ID NO: 583588 - DNA, 491 bp, Homo sapiens; identical to SEQ ID NO: 535294
  misc_feature: HIJSMM301B54Z6.16.68.G02.1.454.light.4.raw

SEQ ID NO: 583589 - DNA, 503 bp, Homo sapiens
  misc_feature: HIJSMM301EL7GL.48.15.B04.1.454.light.4.raw
agtatacatacacgaccggtgctcgatttagacagtatatatccgcgggcacgaccggtgctcgatttagtatagacatcaacacacaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtgagacagttactgttaattatttggcctggtaccagcagaagcctggccaggctcccaggctcctcatctctgctgcatcctacagggccactggcatcccagacaggttcagtggcagtgggtctgggacagacttcactctctccatcagcagactggagcctgaagattttgcaatttattactgtcaccagtatggtagctcacctctaactttcggcggagggaccgaaggta

SEQ ID NO: 583590 - DNA, 478 bp, Homo sapiens; identical to SEQ ID NO: 535129
  misc_feature: HIJSMM301EOHJ7.11.11.A11.1.454.light.4.raw

SEQ ID NO: 583591 - DNA, 503 bp, Homo sapiens
  misc_feature: HIJSMM301E3VMB.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcacgtcctagtcagccaaggccaacccactgtca

SEQ ID NO: 583592 - DNA, 497 bp, Homo sapiens; identical to SEQ ID NO: 534982
  misc_feature: HIJSMM301ANL0N.26.80.H03.1.454.light.4.raw

SEQ ID NO: 583593 - DNA, 485 bp, Homo sapiens
  misc_feature: HIJSMM301BJV5C.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagtcaggatcacctgctctggagataaattggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctgccccc

SEQ ID NO: 583594 - DNA, 486 bp, Homo sapiens; identical to SEQ ID NO: 535043
  misc_feature: HIJSMM301DTLSG.46.35.D02.1.454.light.4.raw

SEQ ID NO: 583595 - DNA, 487 bp, Homo sapiens
  misc_feature: HIJSMM301ESWCG.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagtattttgctaacttactactgtcaacagagttacagtacccgtggacgttcggtccgaacgggaccgaaggtaggaaagtacaaacgaacgtgtggctgcaa

SEQ ID NO: 583596 - DNA, 496 bp, Homo sapiens; identical to SEQ ID NO: 575156
  misc_feature: HIJSMM301BKKY4.26.72.G06.1.454.light.4.raw

SEQ ID NO: 583597 - DNA, 486 bp, Homo sapiens
  misc_feature: HIJSMM301CSR94.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaacgaactgtggctgcaccat

SEQ ID NO: 583598 - DNA, 504 bp, Homo sapiens
  misc_feature: HIJSMM301CFTVI.2.71.G05.1.454.light.4.raw
acgctcgacacacgaccggtgctcgatttagtgtcgtcgcaagagagaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactgggctcaggcggaagatgaggctgactattattgtaagtccgggacagaagtggtaattacatggtgttcggcggagggaccaagctgaccgtcctacgtcagcccaaggctgccccctcggtcactc

SEQ ID NO: 583599 - DNA, 484 bp, Homo sapiens; identical to SEQ ID NO: 535400
  misc_feature: HIJSMM301CBWI0.46.26.C04.1.454.light.4.raw

SEQ ID NO: 583600 - DNA, 508 bp, Homo sapiens
  misc_feature: HIJSMM301EHOAC.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccgaagggaccgaacggtggaaatcaaacgaactagtggctgcaccatctgtcttctatcttccccg

SEQ ID NO: 583601 - DNA, 495 bp, Homo sapiens
  misc_feature: HIJSMM301C86IR.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatacaaacgaactagtggctgcaccatctgtcttc

SEQ ID NO: 583602 - DNA, 485 bp, Homo sapiens
  misc_feature: HIJSMM301DJBRV.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgcccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtcttggtcagcccaggctgcccccg

SEQ ID NO: 583603 - DNA, 515 bp, Homo sapiens
  misc_feature: HIJSMM301D0GQ3.22.36.D03.1.454.light.4.raw
  modified_base (484)..(484): a, c, t, g, unknown or other
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaaccccccactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtnacgcccaaggctgccccctcggtcactctcg

SEQ ID NO: 583604 - DNA, 487 bp, Homo sapiens
  misc_feature: HIJSMM301DNKMS.40.20.B09.1.454.light.4.raw
tctagcgactcacgaccggtgctcgatttagtgtagtgtgaaggggggcctcaggaagccgcatcggaggtgcctcagccatggcatggatccctctcttcctcggcgtccttgcttactgcacaggatccgtggcctcctctgagttgactcagccaccctcagtgtccgtgtccccggacagacagccagcatcacgtgctcaggagatgatttgaacaataaacatgcttgttggtatcaacagaaaccaggccagtcccctgttctggtcatctttgaggattcaaagcggccctcagggatccctgagcgattctctggctccaagtctgcgctcacagccactctgaccatcagcgggacccagcctatggatgaggctgactattattgtcagtcgtgggacagcagcacctcttcctatgtcttcggaactgggacccaggtcaccgtcctcggtcagcccaaggccaacccactgtca

SEQ ID NO: 583605 - DNA, 464 bp, Homo sapiens; identical to SEQ ID NO: 536640
  misc_feature: HIJSMM301D122P.26.78.H01.1.454.light.4.raw

SEQ ID NO: 583606 - DNA, 504 bp, Homo sapiens; identical to SEQ ID NO: 540538
  misc_feature: HIJSMM301C69XH.7.71.G05.1.454.light.4.raw

SEQ ID NO: 583607 - DNA, 500 bp, Homo sapiens
  misc_feature: HIJSMM301DDA1Z.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccggcagcagtgtaacattgtgatattcggcggaggggaccaaaggtgaccgtcctaacgtcagcccaaggctcgccccctcggtccactctccg

SEQ ID NO: 583608 - DNA, 487 bp, Homo sapiens; identical to SEQ ID NO: 536179
  misc_feature: HIJSMM301AIMON.19.57.F02.1.454.light.4.raw

SEQ ID NO: 583609 - DNA, 486 bp, Homo sapiens
  misc_feature: HIJSMM301CG7TK.27.78.H01.1.454.light.4.raw
  modified_base (404)..(404): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaataggcctggaagctgaagatgctgcaacttattacngtcatcagagtactactttacctcaagtgatcaccttcgccaaggacgacgactgaggattaaagaactagtggctgcacca

SEQ ID NO: 583610 - DNA, 502 bp, Homo sapiens
  misc_feature: HIJSMM301DP87E.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgtcgcaggacgacgtaggagtcaacgaactagtggctgcaccactctgtcttctatcttcccgtcccact

SEQ ID NO: 583611 - DNA, 493 bp, Homo sapiens; identical to SEQ ID NO: 536969
  misc_feature: HIJSMM301B0C9U.27.78.H01.1.454.light.4.raw

SEQ ID NO: 583612 - DNA, 486 bp, Homo sapiens
  misc_feature: HIJSMM301BUYWG.48.53.E09.1.454.light.4.raw
agtatacatacacgaccggtgctcgatttagagagagtgtgttgggtttgggggctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactagtggctgcacc

SEQ ID NO: 583613 - DNA, 498 bp, Homo sapiens; identical to SEQ ID NO: 535295
  misc_feature: HIJSMM301BDWWL.15.25.C03.1.454.light.4.raw

SEQ ID NO: 583614 - DNA, 520 bp, Homo sapiens; identical to SEQ ID NO: 537173
  misc_feature: HIJSMM301ANP5V.27.23.C01.1.454.light.4.raw

SEQ ID NO: 583615 - DNA, 518 bp, Homo sapiens; identical to SEQ ID NO: 561292
  misc_feature: HIJSMM301DKO8V.22.30.C08.1.454.light.4.raw
  modified_base (507)..(507): a, c, t, g, unknown or other

SEQ ID NO: 583616 - DNA, 482 bp, Homo sapiens
  misc_feature: HIJSMM301C3S8B.7.83.H06.1.454.light.4.raw
cgtgtctctacacgaccggtgctcgatttagatcacgtgcgtcgcggggctccaaacagagcttcagcaagcatagtgggaatctgcaccatgcccggggctctgctcctcctgaccctcctcactcactctgcagtgtcagtggtccaggcagggctgactcagccgccctcggtgtccaagggcttggggcagaccgccacactcacctgcactgggaacagcaacaatgttggcgaccaaggagcagcttggctgcagcagcaccagggccaccctcccaaactccctatcctacaggaataacaaccggccctcagggatctcggagagattctctgcatccaggtcaggatacacagcctccctgaccattactggactccagcctgaggacgaggctgactattactgctcagcatgggacagcagcctccgtggtgtggtgatcggcggagggaccaggctggaccgtcctaggt

SEQ ID NO: 583617 - DNA, 492 bp, Homo sapiens; identical to SEQ ID NO: 536733
  misc_feature: HIJSMM301DGWA6.40.11.A11.1.454.light.4.raw

SEQ ID NO: 583618 - DNA, 502 bp, Homo sapiens; identical to SEQ ID NO: 539002
  misc_feature: HIJSMM301COFGL.18.59.F04.1.454.light.4.raw

SEQ ID NO: 583619 - DNA, 505 bp, Homo sapiens
  misc_feature: HIJSMM301BS08Z.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggacccaaactgaccgtcctaggtcaagccccaa

SEQ ID NO: 583620 - DNA, 481 bp, Homo sapiens; identical to SEQ ID NO: 567154
  misc_feature: HIJSMM301B7WLT.4.34.D01.1.454.light.4.raw

SEQ ID NO: 583621 - DNA, 460 bp, Homo sapiens
  misc_feature: HIJSMM301BBYH9.5.14.B03.1.454.light.4.raw
atcagacacgcacgaccggtgctcgatttagtgtgagtagttccgcgggggagtcagacccagtcaggacacagcatggacatgagggtccccgctcagctcctggggctcctgctgctctggttcccaggagacagacttactctcacttgtcgggcgagtcacgatattagtaccaggttagcctggtatcagcagaagccagggaaagcccctaaactcctgatctatgctgcatccagtttgcaaagtggggtcccatcgaggttcagcggcagtggatctgggacagatttcactctcaccatcagcaggctgcagcccgaagattttgcaacttactattgtcaaaatactaacagtctcccgcgcagttttggccaggggaccaaaagtggagatcaaacgaaactgtggctgcaccatctgtcttcatcttcccgccatctgacgtgtctat

SEQ ID NO: 583622 - DNA, 502 bp, Homo sapiens
  misc_feature: HIJSMM301A52FL.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccc

SEQ ID NO: 583623 - DNA, 486 bp, Homo sapiens; identical to SEQ ID NO: 535043
  misc_feature: HIJSMM301DCUJ6.46.35.D02.1.454.light.4.raw

SEQ ID NO: 583624 - DNA, 503 bp, Homo sapiens
  misc_feature: HIJSMM301A0X4S.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcacctcaccatcaatagcctggaagctgaagatggctgcaacttattactgtcatcagagtactactttacctcaagtgatcaccttcggccaagggacacgactggagattaaacg

SEQ ID NO: 583625 - DNA, 380 bp, Homo sapiens
  misc_feature: HIJSMM301BH5T9.12.78.H01.1.454.light.4.raw
atacgacgtacacgaccggtgctcgatttagtgtgagtagtttgggtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctggtcactctgttcccaccctcctcctacgtcgtat

SEQ ID NO: 583626 - DNA, 485 bp, Homo sapiens; identical to SEQ ID NO: 538956
  misc_feature: HIJSMM301ATMEP.40.69.G03.1.454.light.4.raw

SEQ ID NO: 583627 - DNA, 508 bp, Homo sapiens; identical to SEQ ID NO: 536388
  misc_feature: HIJSMM301EX4C7.11.57.F02.1.454.light.4.raw

SEQ ID NO: 583628 - DNA, 519 bp, Homo sapiens
  misc_feature: HIJSMM301AM1LP.48.62.F07.1.454.light.4.raw
agtatacatacacgaccggtgctcgatttagtagtcgcataaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccacct

SEQ ID NO: 583629 - DNA, 499 bp, Homo sapiens
  misc_feature: HIJSMM301DLYH9.8.71.G05.1.454.light.4.raw
ctcgcgtgtccacgaccggtgctcgatttagtgtcgtcgcaagagagagggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcagtcagtccattaacaactatttaaattggtatcaacaaaaaccagggaaagcccctaaatacctggtctatactgcatccactttgcaaagtgggtcccatcaaggttcagtggcagtggatttgggacagttttcactctcacaatcagcagtctcgaacctgaagattttgcaacttactactgtcaacagacttacaatataccgaggacgttcggtcaagggaccaaggtgagatcaacgaactgtggctgcaccatctgtcttcatcttcccgcat

SEQ ID NO: 583630 - DNA, 483 bp, Homo sapiens; identical to SEQ ID NO: 536691
  misc_feature: HIJSMM301DKZTI.17.26.C04.1.454.light.4.raw

SEQ ID NO: 583631 - DNA, 487 bp, Homo sapiens; identical to SEQ ID NO: 537079
  misc_feature: HIJSMM301ES0C4.14.55.E11.1.454.light.4.raw

SEQ ID NO: 583632 - DNA, 500 bp, Homo sapiens
  misc_feature: HIJSMM301EOXO9.51.34.D01.1.454.light.4.raw
cgatcgtatacacgaccggtgctcgatttagatcgtctgtgttgggtttggggaggaactgctcagttaggacccagagggaaccatggaagccccagctcagcttctcttcctcctgctactctggctcccagattccaccggagaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataaacgaactgtgctgcaccatctgtcttcta

SEQ ID NO: 583633 - DNA, 498 bp, Homo sapiens
  misc_feature: HIJSMM301AMMVQ.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggagggaccaaggtgaccgtcctacgtcagcccaaggcctgccccctcggtcactctcg

SEQ ID NO: 583634 - DNA, 494 bp, Homo sapiens; identical to SEQ ID NO: 534994
  misc_feature: HIJSMM301A5I3K.27.78.H01.1.454.light.4.raw

SEQ ID NO: 583635 - DNA, 504 bp, Homo sapiens; identical to SEQ ID NO: 539083
  misc_feature: HIJSMM301CQ3Y1.8.19.B08.1.454.light.4.raw

SEQ ID NO: 583636 - DNA, 524 bp, Homo sapiens
  misc_feature: HIJSMM301AWN2U.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccacggacgaacggtaggaagtacgaaacgaacgtagtaggcgtgcgaccactactgtcttctactcttcccgtcccgactctcgt

SEQ ID NO: 583637 - DNA, 496 bp, Homo sapiens
  misc_feature: HIJSMM301AOLY7.52.14.B03.1.454.light.4.raw
cgcagtacgacacgaccggtgctcgatttagtgtgagtagtgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcgggagggaccaagctgaccgtcctaggtcacgcccaaggctcgccccctcggtcactcttccg

SEQ ID NO: 583638 - DNA, 482 bp, Homo sapiens
  misc_feature: HIJSMM301A3CO4.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccaccctcctctacgtgagct

SEQ ID NO: 583639 - DNA, 500 bp, Homo sapiens
  misc_feature: HIJSMM301BVZ56.12.86.H09.1.454.light.4.raw
atacgacgtacacgaccggtgctcgatttagtgctatagacttgggtttgggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggcctaggggaccaagctggagatcaaacgaactgtggctgcaccatctgtcttcat

SEQ ID NO: 583640 - DNA, 463 bp, Homo sapiens; identical to SEQ ID NO: 535062
  misc_feature: HIJSMM301CW0AK.11.73.G07.1.454.light.4.raw

SEQ ID NO: 583641 - DNA, 492 bp, Homo sapiens; identical to SEQ ID NO: 543155
  misc_feature: HIJSMM301ER3BQ.10.53.E09.1.454.light.4.raw

SEQ ID NO: 583642 - DNA, 496 bp, Homo sapiens
  misc_feature: HIJSMM301DH00E.41.18.B07.1.454.light.4.raw
tctatactatcacgaccggtgctcgatttagtcgctgcgtaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggacgaagctgaccgtcctaggtcagcccaaggctgcccctcggtcactctcg

SEQ ID NO: 583643 - DNA, 487 bp, Homo sapiens; identical to SEQ ID NO: 537573
  misc_feature: HIJSMM301E2WT5.3.10.A10.1.454.light.4.raw

SEQ ID NO: 583644 - DNA, 462 bp, Homo sapiens; identical to SEQ ID NO: 537922
  misc_feature: HIJSMM301CEK4L.10.9.A09.1.454.light.4.raw

SEQ ID NO: 583645 - DNA, 474 bp, Homo sapiens
  misc_feature: HIJSMM301DRYKW.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctggactgaagtgcatatgaagagaactgtgctgca

SEQ ID NO: 583646 - DNA, 464 bp, Homo sapiens; identical to SEQ ID NO: 536640
  misc_feature: HIJSMM301CAY2M.26.78.H01.1.454.light.4.raw

SEQ ID NO: 583647 - DNA, 484 bp, Homo sapiens; identical to SEQ ID NO: 535400
  misc_feature: HIJSMM301DAOBK.46.26.C04.1.454.light.4.raw

SEQ ID NO: 583648 - DNA, 520 bp, Homo sapiens; identical to SEQ ID NO: 535686
  misc_feature: HIJSMM301EJSVE.41.19.B08.1.454.light.4.raw

SEQ ID NO: 583649 - DNA, 489 bp, Homo sapiens; identical to SEQ ID NO: 553026
  misc_feature: HIJSMM301AM9EQ.5.47.E03.1.454.light.4.raw

SEQ ID NO: 583650 - DNA, 505 bp, Homo sapiens
  misc_feature: HIJSMM301ADMWO.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgtaacttactactgtcaacagacttacaatataccgaggacgttcggtcaagggaccaaggtggagatcaaacgaactgtggctgcaccatctgtcttcatcttcccgccat

SEQ ID NO: 583651 - DNA, 473 bp, Homo sapiens
  misc_feature: HIJSMM301CMOC1.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttgggcggggggaccaaggtggacatcaaacgaa

SEQ ID NO: 583652 - DNA, 505 bp, Homo sapiens
  misc_feature: HIJSMM301CZBD6.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccaggctgaccgtcggcggtcagccaaggctcgccccctcggtcactctcgttcccgccctcct

SEQ ID NO: 583653 - DNA, 488 bp, Homo sapiens; identical to SEQ ID NO: 540982
  misc_feature: HIJSMM301EC3S6.8.4.A04.1.454.light.4.raw

SEQ ID NO: 583654 - DNA, 491 bp, Homo sapiens
  misc_feature: HIJSMM301CK6UP.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggtagggaccaaggtggaggatcaaacgaactgtggctgcaccat

SEQ ID NO: 583655 - DNA, 496 bp, Homo sapiens
  misc_feature: HIJSMM301ED30R.10.79.H02.1.454.light.4.raw
catagtagtgcacgaccggtgctcgatttagtgtcacacgaagggaaaggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctcgtcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccacggggaccaagctggagatcaaacgaactgtggctgcaccatctgtctt

SEQ ID NO: 583656 - DNA, 504 bp, Homo sapiens
  misc_feature: HIJSMM301BZ0GV.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatcgtgggacagtatttcactctcaccatccgcggtctgcaacctgaagtatttcgctaacttactactgtacaacagacttacacgtccgccccccgatccaccttccggaccgaagggacacgacgtggagaattaaacgaactgtggctgcaccatctgtcttcatt

SEQ ID NO: 583657 - DNA, 483 bp, Homo sapiens
  misc_feature: HIJSMM301CK3R0.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctcggggtccctgacaggttcagtggcagtggatcaggcacagattttacactgaaaatcagcagagtggaggctgaggatgttgggctctattattgcatgcaagctctacaagtcccgctcactttcggcggagggaccaagggtggagatcaaagaa

SEQ ID NO: 583658 - DNA, 496 bp, Homo sapiens
  misc_feature: HIJSMM301A315L.43.36.D03.1.454.light.4.raw
tgtgagtagtcacgaccggtgctcgatttagctgcgtcacgatctctcttgggggctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctcgtgggacagacttcgctctcaccatcaacagcctccaggctgaggatggcggtcggtttattattgtacaactaattattttagtgtctccgttactacttttggccaggggaccaagttggagatacaaacgaa

SEQ ID NO: 583659 - DNA, 496 bp, Homo sapiens
  misc_feature: HIJSMM301C10D2.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactggaccaaggtcaccgtcctaggtcagcccaagg

SEQ ID NO: 583660 - DNA, 509 bp, Homo sapiens
  misc_feature: HIJSMM301ANK9O.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcgggaccaaattagagatcaaacgaactagtggctgcaccatctgtcttcatcttcccgccact

SEQ ID NO: 583661 - DNA, 496 bp, Homo sapiens; identical to SEQ ID NO: 558251
  misc_feature: HIJSMM301DJEMK.16.78.H01.1.454.light.4.raw

SEQ ID NO: 583662 - DNA, 494 bp, Homo sapiens
  misc_feature: HIJSMM301DN0NI.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggacgaactgtggctgcaccatctgtctt

SEQ ID NO: 583663 - DNA, 505 bp, Homo sapiens; identical to SEQ ID NO: 535503
  misc_feature: HIJSMM301A1S3H.8.28.C06.1.454.light.4.raw

SEQ ID NO: 583664 - DNA, 489 bp, Homo sapiens; identical to SEQ ID NO: 536663
  misc_feature: HIJSMM301BFZDM.16.72.G06.1.454.light.4.raw

SEQ ID NO: 583665 - DNA, 489 bp, Homo sapiens; identical to SEQ ID NO: 535139
  misc_feature: HIJSMM301BWJB8.14.55.E11.1.454.light.4.raw

SEQ ID NO: 583666 - DNA, 441 bp, Homo sapiens; identical to SEQ ID NO: 535074
  misc_feature: HIJSMM301A2CPE.11.3.A03.1.454.light.4.raw

SEQ ID NO: 583667 - DNA, 505 bp, Homo sapiens; identical to SEQ ID NO: 537876
  misc_feature: HIJSMM301CRJNZ.5.68.G02.1.454.light.4.raw

SEQ ID NO: 583668 - DNA, 490 bp, Homo sapiens
  misc_feature: HIJSMM301CTZRY.4.27.C05.1.454.light.4.raw
agcactgtagcacgaccggtgctcgatttagacgcgatcgaagggtttggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatggttgggtttactactgcatgcaagctctacaagccacctactacttttcggccaggggaccaggctggagatacaaacgaact

SEQ ID NO: 583669 - DNA, 514 bp, Homo sapiens
  misc_feature: HIJSMM301BXM9G.13.81.H04.1.454.light.4.raw
tcacgtactacacgaccggtgctcgatttagtagtgtagattcgcggggggggtctcaggaggcagcgctctcgggacgtctccaccatggcctgggctctgctattcctcaccctcctcactcagggcatagggtcctgggcccagtctgccctgactcagcctgcctccgtgtctgggtctcctggacagtcgatcaccatctcctgcactgggaccagcagtgacgttcgtggtcaagactatgtctcctggtaccaacaacacccaggcaaggcccccaaactcataatttatgatttcactaatcggccctcaggtgtatctaatcgcttcactggctccaagtctggcaacacggcctccctgaccatctctgggctccaggcagaggacgaggctgattattactgcggctcctggacgattagcaccctttatgtcttcgggactgtgaccaaggtcaccgtcctaggtcagcccaaggccaaccccactgtcactctgttcccta

SEQ ID NO: 583670 - DNA, 515 bp, Homo sapiens; identical to SEQ ID NO: 556682
  misc_feature: HIJSMM301AG32J.40.12.B01.1.454.light.4.raw

SEQ ID NO: 583671 - DNA, 499 bp, Homo sapiens
  misc_feature: HIJSMM301AD69B.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatctt

SEQ ID NO: 583672 - DNA, 488 bp, Homo sapiens; identical to SEQ ID NO: 535725
  misc_feature: HIJSMM301B3V9I.12.88.H11.1.454.light.4.raw

SEQ ID NO: 583673 - DNA, 491 bp, Homo sapiens; identical to SEQ ID NO: 537594
  misc_feature: HIJSMM301C0CXK.4.24.C02.1.454.light.4.raw

SEQ ID NO: 583674 - DNA, 490 bp, Homo sapiens; identical to SEQ ID NO: 541407
  misc_feature: HIJSMM301ADS0D.14.55.E11.1.454.light.4.raw

SEQ ID NO: 583675 - DNA, 485 bp, Homo sapiens
  misc_feature: HIJSMM301DXWS5.49.1.A01.1.454.light.4.raw
agtcgagagacacgaccggtgctcgatttagacgtctcatcagggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatttcctgcactgggagcagctccaacatcggggcaggttatgatgtacactggtatcagcagcttccaggaacagcccccaaactcctcatctatagtaacaaaaatcggccctcaggggtccctgaccgattctctggctccaagtctgacacctcagcctccctggccatcactgggctccaggctgaggatgaggcggagtattactgccagtcctatgacagcagcctgagtggtcttgtcttcggaactgggaccaaggtcaccgtcctgggt

SEQ ID NO: 583676 - DNA, 434 bp, Homo sapiens; identical to SEQ ID NO: 535153
  misc_feature: HIJSMM301CTJEF.18.5.A05.1.454.light.4.raw

SEQ ID NO: 583677 - DNA, 487 bp, Homo sapiens; identical to SEQ ID NO: 539157
  misc_feature: HIJSMM301EQSPF.26.37.D04.1.454.light.4.raw

SEQ ID NO: 583678 - DNA, 486 bp, Homo sapiens; identical to SEQ ID NO: 535043
  misc_feature: HIJSMM301BDNCR.46.35.D02.1.454.light.4.raw

SEQ ID NO: 583679 - DNA, 486 bp, Homo sapiens; identical to SEQ ID NO: 537127
  misc_feature: HIJSMM301B4T17.3.77.G11.1.454.light.4.raw

SEQ ID NO: 583680 - DNA, 501 bp, Homo sapiens; identical to SEQ ID NO: 555551
  misc_feature: HIJSMM301DV6CT.21.81.H04.1.454.light.4.raw

SEQ ID NO: 583681 - DNA, 460 bp, Homo sapiens; identical to SEQ ID NO: 536053
  misc_feature: HIJSMM301B1FSO.22.28.C06.1.454.light.4.raw

SEQ ID NO: 583682 - DNA, 485 bp, Homo sapiens
  misc_feature: HIJSMM301E147A.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaaccaccctgtcgttggttttggtctgttcggcggcgggacc

SEQ ID NO: 583683 - DNA, 504 bp, Homo sapiens
  misc_feature: HIJSMM301B5BO4.3.27.C05.1.454.light.4.raw
  modified_base (501)..(501): a, c, t, g, unknown or other
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctggggcagatttcactctcaccatcagcagcctgcaggctgaagatgtggcagtttattactgtcagcaatattatactcctcttccgacgttcggccaagggaccaaggtggaaatcaaacgaactgtggctgcaccatntcg

SEQ ID NO: 583684 - DNA, 494 bp, Homo sapiens
  misc_feature: HIJSMM301EFZIW.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggaggatcaaacgaactgtgg

SEQ ID NO: 583685 - DNA, 508 bp, Homo sapiens
  misc_feature: HIJSMM301EVW7D.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccgagggaaccgaaggtaggaaagtacaaacgaactagtggctgcacactctgtcttctatcttccccg

SEQ ID NO: 583686 - DNA, 494 bp, Homo sapiens; identical to SEQ ID NO: 534992
  misc_feature: HIJSMM301CJHOQ.9.1.A01.1.454.light.4.raw

SEQ ID NO: 583687 - DNA, 530 bp, Homo sapiens
  misc_feature: HIJSMM301E3AMT.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggtcgggaggggatcagtctcgaccggtcccttaacggttcgacgacccccgaaacgggcgttcggccccccctcccgggttaccaaccttcc

SEQ ID NO: 583688 - DNA, 512 bp, Homo sapiens
  misc_feature: HIJSMM301BFN2E.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaactccggggtccctgaccgattcagtggcagcgggtctgggacagatttcactctcaccatcagcagcctgcaggctgaagatgtggctagtttattactgtcaactagttttctcgggcgttcggccgaacggaccgaaggtaggaaagtacaaacgaacgtagtggctgcacatctgtcttctatcttccccg

SEQ ID NO: 583689 - DNA, 404 bp, Homo sapiens; identical to SEQ ID NO: 535530
  misc_feature: HIJSMM301B1WBR.4.35.D02.1.454.light.4.raw

SEQ ID NO: 583690 - DNA, 505 bp, Homo sapiens; identical to SEQ ID NO: 583311
  misc_feature: HIJSMM301BP7T2.7.71.G05.1.454.light.4.raw

SEQ ID NO: 583691 - DNA, 483 bp, Homo sapiens
  misc_feature: HIJSMM301DCJN8.48.5.A05.1.454.light.4.raw
agtatacatacacgaccggtgctcgatttagatagatagacagggggcaggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatacaaacgaactagtggctgcaccta

SEQ ID NO: 583692 - DNA, 497 bp, Homo sapiens; identical to SEQ ID NO: 536376
  misc_feature: HIJSMM301C4FM6.22.9.A09.1.454.light.4.raw

SEQ ID NO: 583693 - DNA, 504 bp, Homo sapiens
  misc_feature: HIJSMM301CLTA7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtggaaatcaaacgaactgtggctgcaccatctgtcttcatcttccccg

SEQ ID NO: 583694 - DNA, 494 bp, Homo sapiens; identical to SEQ ID NO: 534992
  misc_feature: HIJSMM301CWM34.9.1.A01.1.454.light.4.raw

SEQ ID NO: 583695 - DNA, 486 bp, Homo sapiens; identical to SEQ ID NO: 537127
  misc_feature: HIJSMM301AZTH0.3.77.G11.1.454.light.4.raw

SEQ ID NO: 583696 - DNA, 507 bp, Homo sapiens; identical to SEQ ID NO: 535641
  misc_feature: HIJSMM301C4PO2.10.88.H11.1.454.light.4.raw

SEQ ID NO: 583697 - DNA, 487 bp, Homo sapiens
  misc_feature: HIJSMM301DLSEJ.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtagagatcaaaggaactgtggctgcaccatctgtcttcta

SEQ ID NO: 583698 - DNA, 504 bp, Homo sapiens; identical to SEQ ID NO: 539083
  misc_feature: HIJSMM301CXZ3I.8.19.B08.1.454.light.4.raw

SEQ ID NO: 583699 - DNA, 486 bp, Homo sapiens; identical to SEQ ID NO: 535458
  misc_feature: HIJSMM301BF2RV.7.75.G09.1.454.light.4.raw

SEQ ID NO: 583700 - DNA, 515 bp, Homo sapiens
  misc_feature: HIJSMM301ESSKN.49.10.A10.1.454.light.4.raw
agtcgagagacacgaccggtgctcgatttagcgtcgatctcaggggagtctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtgatacggaccattgggtgttcggcggagggaccaaggtgaccgtctaggtcagcccaaggctgccccctcggtcactctgttcccgcctcctctct

SEQ ID NO: 583701 - DNA, 492 bp, Homo sapiens; identical to SEQ ID NO: 578828
  misc_feature: HIJSMM301BLHBZ.49.61.F06.1.454.light.4.raw

SEQ ID NO: 583702 - DNA, 486 bp, Homo sapiens; identical to SEQ ID NO: 535043
  misc_feature: HIJSMM301EMKE0.46.35.D02.1.454.light.4.raw

SEQ ID NO: 583703 - DNA, 494 bp, Homo sapiens; identical to SEQ ID NO: 534992
  misc_feature: HIJSMM301DJEB7.9.1.A01.1.454.light.4.raw

SEQ ID NO: 583704 - DNA, 478 bp, Homo sapiens; identical to SEQ ID NO: 535129
  misc_feature: HIJSMM301EY5P0.11.11.A11.1.454.light.4.raw

SEQ ID NO: 583705 - DNA, 499 bp, Homo sapiens
  misc_feature: HIJSMM301CHK4J.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactgggaccacggtcaccgtctaggt

SEQ ID NO: 583706 - DNA, 492 bp, Homo sapiens
  misc_feature: HIJSMM301BZIJK.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagccaagg

SEQ ID NO: 583707 - DNA, 480 bp, Homo sapiens; identical to SEQ ID NO: 545225
  misc_feature: HIJSMM301C1CQO.43.12.B01.1.454.light.4.raw

SEQ ID NO: 583708 - DNA, 518 bp, Homo sapiens
  misc_feature: HIJSMM301AZCFS.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctccgtggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggacaaggtggcaatcaaccgaactgtggctgcaccatctgtcttctatcttccccg

SEQ ID NO: 583709 - DNA, 486 bp, Homo sapiens; identical to SEQ ID NO: 551132
  misc_feature: HIJSMM301CC3W5.4.71.G05.1.454.light.4.raw

SEQ ID NO: 583710 - DNA, 469 bp, Homo sapiens; identical to SEQ ID NO: 536091
  misc_feature: HIJSMM301BQGFK.3.82.H05.1.454.light.4.raw

SEQ ID NO: 583711 - DNA, 490 bp, Homo sapiens; identical to SEQ ID NO: 543909
  misc_feature: HIJSMM301DIDES.14.55.E11.1.454.light.4.raw

SEQ ID NO: 583712 - DNA, 493 bp, Homo sapiens; identical to SEQ ID NO: 537281
  misc_feature: HIJSMM301A16K5.9.1.A01.1.454.light.4.raw

SEQ ID NO: 583713 - DNA, 489 bp, Homo sapiens; identical to SEQ ID NO: 546326
  misc_feature: HIJSMM301AHBO0.14.33.C11.1.454.light.4.raw

SEQ ID NO: 583714 - DNA, 505 bp, Homo sapiens
  misc_feature: HIJSMM301CAQNN.13.53.E09.1.454.light.4.raw
  modified_base (472)..(472): a, c, t, g, unknown or other
  modified_base (477)..(477): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaaggaccaaggtaggaagtacaagacgaacngtggntgcgaccatctgtcttcactcttcccgt

SEQ ID NO: 583715 - DNA, 486 bp, Homo sapiens; identical to SEQ ID NO: 544417
  misc_feature: HIJSMM301CP787.41.21.B10.1.454.light.4.raw

SEQ ID NO: 583716 - DNA, 444 bp, Homo sapiens; identical to SEQ ID NO: 535856
  misc_feature: HIJSMM301DDDZO.9.9.A09.1.454.light.4.raw

SEQ ID NO: 583717 - DNA, 475 bp, Homo sapiens; identical to SEQ ID NO: 564797
  misc_feature: HIJSMM301EYDA8.7.81.H04.1.454.light.4.raw

SEQ ID NO: 583718 - DNA, 504 bp, Homo sapiens
  misc_feature: HIJSMM301B9WFQ.40.34.D01.1.454.light.4.raw
tctagcgactcacgaccggtgctcgatttagatcgtctgtgttgggtttggggggtagctcaggaagcagagcctggagcatctccactatggcctgggctccactacttctcaccctcctcgctcactgcacaggttcttgggccaattttatgctgactcagccccactctgtgtcggggtctccggggaagacggtaaccatctcctgcacccgcagtagtggcagcattgccagcaactatgtgcagtggtaccagcagcgcccgggcagttcccccacactttaatctatgaggataacaaaagactctctggggtccctgatcggttctctggctccatcgacagctcctccaattctgcctccctcaccatctctggactgaagactgaggacgaggctgattattactgtcagagttatgatgacaccaattactgggtgttcggcggagggaccaagctgaccgtcctaggtcagcccaaggctgccccctcggt

SEQ ID NO: 583719 - DNA, 476 bp, Homo sapiens
  misc_feature: HIJSMM301DWY65.49.4.A04.1.454.light.4.raw
agtcgagagacacgaccggtgctcgatttagagtagtgatcagggggtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagtattttactttcaccatcagcaggctgcagcctgaagatattgcaacatattactgtcaacagtatgatcgcctcccgctcactttcgggcgggggaccgaagggtggaggatcaagcgaactgtggctgcaa

SEQ ID NO: 583720 - DNA, 477 bp, Homo sapiens; identical to SEQ ID NO: 535122
  misc_feature: HIJSMM301EV7YE.26.72.G06.1.454.light.4.raw

SEQ ID NO: 583721 - DNA, 486 bp, Homo sapiens
  misc_feature: HIJSMM301ALFT2.41.34.D01.1.454.light.4.raw
tctatactatcacgaccggtgctcgatttagatcgtctgtgttgggtttggggagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaaggcgaactgtggctgcacctatcttcg

SEQ ID NO: 583722 - DNA, 501 bp, Homo sapiens; identical to SEQ ID NO: 536818
  misc_feature: HIJSMM301AOY9L.12.82.H05.1.454.light.4.raw

SEQ ID NO: 583723 - DNA, 482 bp, Homo sapiens
  misc_feature: HIJSMM301BVVYB.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggccacgttcggccaagggaccaaggtggaaatcaaacgaactgtggctgcaccatctgtctt

SEQ ID NO: 583724 - DNA, 503 bp, Homo sapiens
  misc_feature: HIJSMM301BMFOG.12.67.G01.1.454.light.4.raw
  modified_base (445)..(445): a, c, t, g, unknown or other
atacgacgtacacgaccggtgctcgatttagagtatacatattgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctcctgaccatctctgggctccaggctgaggacgaggctgattattattgcagctcatatacaagcagcagccaccctntttgtcttcggaagtgggaccaaggtccaccgtcctacgtcagcccaaggcccaaccc

SEQ ID NO: 583725 - DNA, 494 bp, Homo sapiens; identical to SEQ ID NO: 534994
  misc_feature: HIJSMM301COYNZ.27.78.H01.1.454.light.4.raw

SEQ ID NO: 583726 - DNA, 485 bp, Homo sapiens
  misc_feature: HIJSMM301E2DVQ.52.69.G03.1.454.light.4.raw
cgcagtacgacacgaccggtgctcgatttagtcgctgcgtaaaggagaaagggggggtcagtcccagtcaggacacagcatggacatgagggtccccgctcagctcctggggctcctgctgctctggctcccaggtgccagatgtgacatccagttgacccagtctccatccttcctgtctgcatctgtgggggacagagtcaccatcacttgccggaccagtgaggacatctacactagattagcctggtatcagcaagaaccggggagagcccctaaactcctgatccatactgcatccactttgcatgctggggtcccattcaggttcggcggcagtggatctgggacagaattcactctcacaatcagcagcctgcagactgaagactccgcaatttattactgtcaacaacgtcaccgttacccgatcaccttcggccaagggacacggctggagattaaacgaactgtggctgcaccat

SEQ ID NO: 583727 - DNA, 494 bp, Homo sapiens
  misc_feature: HIJSMM301A0XMP.10.79.H02.1.454.light.4.raw
catagtagtgcacgaccggtgctcgatttagtgtcacacgaagggaaagggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaacgaactgtggctgcaccatctgtcttcta

SEQ ID NO: 583728 - DNA, 509 bp, Homo sapiens
  misc_feature: HIJSMM301DR924.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaacggtggaaatacaaacgaactagtggctgcaccactctgtcttctatcttccccg

SEQ ID NO: 583729 - DNA, 497 bp, Homo sapiens
  misc_feature: HIJSMM301AP736.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaaggtggaggatcaaaacgaactgttggc

SEQ ID NO: 583730 - DNA, 491 bp, Homo sapiens
  misc_feature: HIJSMM301BFKH1.19.71.G05.1.454.light.4.raw
  modified_base (489)..(489): a, c, t, g, unknown or other
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgngg

SEQ ID NO: 583731 - DNA, 517 bp, Homo sapiens; identical to SEQ ID NO: 541566
  misc_feature: HIJSMM301COY66.22.30.C08.1.454.light.4.raw

SEQ ID NO: 583732 - DNA, 476 bp, Homo sapiens; identical to SEQ ID NO: 554798
  misc_feature: HIJSMM301C7V8A.48.2.A02.1.454.light.4.raw

SEQ ID NO: 583733 - DNA, 479 bp, Homo sapiens; identical to SEQ ID NO: 558912
  misc_feature: HIJSMM301D585M.40.23.C01.1.454.light.4.raw

SEQ ID NO: 583734 - DNA, 490 bp, Homo sapiens
  misc_feature: HIJSMM301BOTXN.49.60.F05.1.454.light.4.raw
agtcgagagacacgaccggtgctcgatttagtacgtcatcagggaaagggggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcaggctttgatgtccactggtaccagcagcttccaggaacagcccccaaactcctcatctatggtaacaacaatcggccctcaggggtccctgaccgattctctgcctccaagtctgccacctcggcctccctggccatcactgggctccaggctgaagatgaggctgattattactgccagtcctatgacagcaccatgagtcgttccgtggtcttcggcggagggacccagctgaccgtcctaggtcagcccaagg

SEQ ID NO: 583735 - DNA, 492 bp, Homo sapiens
  misc_feature: HIJSMM301CXAU1.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgctagtttattactgtcagcagtataattactggcctcggacgttcggccaaggaccgaaggtggaagtacaacgaactgtggctgcaccatctgtctt

SEQ ID NO: 583736 - DNA, 480 bp, Homo sapiens
  misc_feature: HIJSMM301C3V3N.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcaggtgggtctgggacagagttcactctcaccatcagcagcctgcagtctgaggatattgcagtttattactgtcagcagtatactaactggcctctgacgttcggccaagggaccagggtggaaatcaaacgaactgtggctgcaccat

SEQ ID NO: 583737 - DNA, 497 bp, Homo sapiens
  misc_feature: HIJSMM301C2P4F.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagctaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatctgt

SEQ ID NO: 583738 - DNA, 520 bp, Homo sapiens
  misc_feature: HIJSMM301AJW4K.10.38.D05.1.454.light.4.raw
catagtagtgcacgaccggtgctcgatttagtatctgatagttggggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccct

SEQ ID NO: 583739 - DNA, 507 bp, Homo sapiens; identical to SEQ ID NO: 568626
  misc_feature: HIJSMM301D8F19.19.78.H01.1.454.light.4.raw

SEQ ID NO: 583740 - DNA, 484 bp, Homo sapiens; identical to SEQ ID NO: 538157
  misc_feature: HIJSMM301E2MW4.26.70.G04.1.454.light.4.raw

SEQ ID NO: 583741 - DNA, 508 bp, Homo sapiens; identical to SEQ ID NO: 536388
  misc_feature: HIJSMM301A7IUG.11.57.F02.1.454.light.4.raw

SEQ ID NO: 583742 - DNA, 511 bp, Homo sapiens
  misc_feature: HIJSMM301CADN7.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaacccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtcctaggtcagcccaaggccaacccactgtcactctcg

SEQ ID NO: 583743 - DNA, 497 bp, Homo sapiens
  misc_feature: HIJSMM301CUE3F.40.73.G07.1.454.light.4.raw
tctagcgactcacgaccggtgctcgatttagctctacgctcagggggctgctcagttaggacccagagggaaccatggaaaccccagcgcaacttctcttcctcctgctactctggctcccagaaaccaccggagaaatagtgttgaagcagtctccagacaccctgtctttgtctccaggggggagagccaccctctcctgcagggccagtcagagtgttagcagcaactccattgcctggtaccagcagaaacctggccagtctcccaggctcctcatctatggtgcttcgaccaggctcaccggcatccctgacaggttcactgccagtgggtctgggacagacttcactctcatcatcaccagactagaacctgaggattttgcagtgtatttttgtcaacaacatgataagtcaccgttcagctttggccgggggacccaggtggagatcaaacgaactgtggctgcaccatctgtcttcatcttccgccat

SEQ ID NO: 583744 - DNA, 504 bp, Homo sapiens
  misc_feature: HIJSMM301B86GJ.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttagggagggccactggcatcccacccaggttcagtggcagtgggtctgggacagacttcattctcaccatccgcagcctagagcctgaagattttgcagtttattactgtcaacagcgtagcagcaggcctccggcgacgttcgccaggacaaggtggagtcaagcgaactgtggctgcaccatctgtcttcatcttcccgcc

SEQ ID NO: 583745 - DNA, 447 bp, Homo sapiens; identical to SEQ ID NO: 535201
  misc_feature: HIJSMM301CSS7B.18.9.A09.1.454.light.4.raw

SEQ ID NO: 583746 - DNA, 484 bp, Homo sapiens; identical to SEQ ID NO: 566906
  misc_feature: HIJSMM301AQNTU.8.49.E05.1.454.light.4.raw

SEQ ID NO: 583747 - DNA, 496 bp, Homo sapiens; identical to SEQ ID NO: 535109
  misc_feature: HIJSMM301CY8V8.16.78.H01.1.454.light.4.raw

SEQ ID NO: 583748 - DNA, 485 bp, Homo sapiens; identical to SEQ ID NO: 535880
  misc_feature: HIJSMM301ETOFK.7.75.G09.1.454.light.4.raw

SEQ ID NO: 583749 - DNA, 486 bp, Homo sapiens
  misc_feature: HIJSMM301A9306.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccctaagaacttttggccagggaccaagctggagatcaaacgaactgtggctgcaccat

SEQ ID NO: 583750 - DNA, 512 bp, Homo sapiens
  misc_feature: HIJSMM301EO8BG.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccacccctcctccgtgtctgat

SEQ ID NO: 583751 - DNA, 486 bp, Homo sapiens; identical to SEQ ID NO: 535043
  misc_feature: HIJSMM301AI42M.46.35.D02.1.454.light.4.raw

SEQ ID NO: 583752 - DNA, 489 bp, Homo sapiens; identical to SEQ ID NO: 535091
  misc_feature: HIJSMM301BY3EY.47.36.D03.1.454.light.4.raw

SEQ ID NO: 583753 - DNA, 487 bp, Homo sapiens; identical to SEQ ID NO: 536536
  misc_feature: HIJSMM301DTHMP.26.45.E01.1.454.light.4.raw

SEQ ID NO: 583754 - DNA, 498 bp, Homo sapiens
  misc_feature: HIJSMM301B44M5.51.7.A07.1.454.light.4.raw
cgatcgtatacacgaccggtgctcgatttagcacgtgtcgcaggggtccaaacagagcttcagcaagcatagtgggaatctgcaccatgccctgggctctgctcctcctgaccctcctcactcactctgcagtgtcagtggtcccggcaggactgacgcagccaccctcggtgtccaagggcttgagacagaccgccacactcacctgcattgggaactactacaatgtgggcgaccaaggaacactttggctgcagcagtaccagggccaccctcccaaactcctgtcctacagggataatacccggccctcagggatctcagagagattctcagcttccacgtcaggatacacagcctccctgaccattactggactccagcctggggacgaggctgactattactgctcagcgtgggacagcagcctcagagcttgggtgttcggcggagggaccaggctgaccgtcctgagtcagcccaacggctcgccccccg

SEQ ID NO: 583755 - DNA, 503 bp, Homo sapiens
  misc_feature: HIJSMM301COG0M.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaagtacaaacgaactaggtgcgtgcacca

SEQ ID NO: 583756 - DNA, 501 bp, Homo sapiens
  misc_feature: HIJSMM301CQ4IA.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccaaggccaaccca

SEQ ID NO: 583757 - DNA, 447 bp, Homo sapiens
  misc_feature: HIJSMM301CQ4GE.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgacccctcctctacgtgagct

SEQ ID NO: 583758 - DNA, 505 bp, Homo sapiens
  misc_feature: HIJSMM301DV415.48.15.B04.1.454.light.4.raw
agtatacatacacgaccggtgctcgatttagacagtatatatccgcgggcacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatatattctactccgccgacgtcgccgggacgaacgtcg

SEQ ID NO: 583759 - DNA, 505 bp, Homo sapiens; identical to SEQ ID NO: 535503
  misc_feature: HIJSMM301DBNMP.8.28.C06.1.454.light.4.raw

SEQ ID NO: 583760 - DNA, 499 bp, Homo sapiens; identical to SEQ ID NO: 541382
  misc_feature: HIJSMM301C79FJ.11.21.B10.1.454.light.4.raw

SEQ ID NO: 583761 - DNA, 486 bp, Homo sapiens
  misc_feature: HIJSMM301DQVWH.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttccccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagataaacgaactgtggctgcacat

SEQ ID NO: 583762 - DNA, 502 bp, Homo sapiens
  misc_feature: HIJSMM301CGX9C.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcacgccaaggctcgccccctcggtcact

SEQ ID NO: 583763 - DNA, 441 bp, Homo sapiens; identical to SEQ ID NO: 534971
  misc_feature: HIJSMM301CTHS9.11.3.A03.1.454.light.4.raw

SEQ ID NO: 583764 - DNA, 454 bp, Homo sapiens; identical to SEQ ID NO: 534964
  misc_feature: HIJSMM301BHN0R.19.86.H09.1.454.light.4.raw

SEQ ID NO: 583765 - DNA, 494 bp, Homo sapiens; identical to SEQ ID NO: 534992
  misc_feature: HIJSMM301DRSSO.9.1.A01.1.454.light.4.raw

SEQ ID NO: 583766 - DNA, 494 bp, Homo sapiens; identical to SEQ ID NO: 534992
  misc_feature: HIJSMM301B79I3.9.1.A01.1.454.light.4.raw

SEQ ID NO: 583767 - DNA, 460 bp, Homo sapiens; identical to SEQ ID NO: 549551
  misc_feature: HIJSMM301DFJX1.48.73.G07.1.454.light.4.raw

SEQ ID NO: 583768 - DNA, 491 bp, Homo sapiens; identical to SEQ ID NO: 535294
  misc_feature: HIJSMM301EW00F.16.68.G02.1.454.light.4.raw

SEQ ID NO: 583769 - DNA, 456 bp, Homo sapiens
  misc_feature: HIJSMM301C4VXE.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 583770 - DNA, 513 bp, Homo sapiens
  misc_feature: HIJSMM301B8T3I.43.5.A05.1.454.light.4.raw
  modified_base (503)..(503): a, c, t, g, unknown or other
tgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctgccccctcggtcactctgttcccnccctcctcta

SEQ ID NO: 583771 - DNA, 543 bp, Homo sapiens
  misc_feature: HIJSMM301E3VPY.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaacggaccgaacggtaggaaggtacgaaacgaaactaacgtaggtcgtcgtcgaccaactacttacgtcttccttactaccttcccgtccctacctcctcgt

SEQ ID NO: 583772 - DNA, 506 bp, Homo sapiens
  misc_feature: HIJSMM301DZDQN.15.59.F04.1.454.light.4.raw
  modified_base (435)..(435): a, c, t, g, unknown or other
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttatattgtgtcctatatatgggtnctggcatttcggtcttcggcggagggaccaagctgaccgtcctaggtcagcccaaggctcgccccctggta

SEQ ID NO: 583773 - DNA, 503 bp, Homo sapiens
  misc_feature: HIJSMM301DUH3B.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacacctgactggtccgggagtgttcggcggagggaccaagctgaccgtctaggtcagcccaaggcacgccccctggtcactt

SEQ ID NO: 583774 - DNA, 509 bp, Homo sapiens; identical to SEQ ID NO: 536047
  misc_feature: HIJSMM301BQFEC.17.33.C11.1.454.light.4.raw

SEQ ID NO: 583775 - DNA, 519 bp, Homo sapiens; identical to SEQ ID NO: 550353
  misc_feature: HIJSMM301DSN7H.5.27.C05.1.454.light.4.raw

SEQ ID NO: 583776 - DNA, 503 bp, Homo sapiens
  misc_feature: HIJSMM301CDDLP.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtcttgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggaggaccaaggtggacctcaaacgaactgtggctgcacatctgtcttcatcttcccgc

SEQ ID NO: 583777 - DNA, 471 bp, Homo sapiens
  misc_feature: HIJSMM301BQKAD.8.85.H08.1.454.light.4.raw
  modified_base (370)..(370): a, c, t, g, unknown or other
ctcgcgtgtccacgaccggtgctcgatttagtatcactcagtcggcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcngtctgcaacctgaagatttgcaatttattactgtcaagagactcacaatggagcactttgccagggaccaagctggagaggaacgaactgtggctgcacat

SEQ ID NO: 583778 - DNA, 460 bp, Homo sapiens; identical to SEQ ID NO: 537107
  misc_feature: HIJSMM301BPCV2.22.28.C06.1.454.light.4.raw

SEQ ID NO: 583779 - DNA, 494 bp, Homo sapiens; identical to SEQ ID NO: 544718
  misc_feature: HIJSMM301A3Z2S.47.64.F09.1.454.light.4.raw

SEQ ID NO: 583780 - DNA, 494 bp, Homo sapiens; identical to SEQ ID NO: 534994
  misc_feature: HIJSMM301CP7M9.27.78.H01.1.454.light.4.raw

SEQ ID NO: 583781 - DNA, 491 bp, Homo sapiens; identical to SEQ ID NO: 562326
  misc_feature: HIJSMM301EEKWT.3.10.A10.1.454.light.4.raw

SEQ ID NO: 583782 - DNA, 504 bp, Homo sapiens; identical to SEQ ID NO: 535495
  misc_feature: HIJSMM301AZIWO.14.86.H09.1.454.light.4.raw

SEQ ID NO: 583783 - DNA, 490 bp, Homo sapiens
  misc_feature: HIJSMM301B6MZT.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggaggaccgaaggtggagatcaaacgaactgt

SEQ ID NO: 583784 - DNA, 492 bp, Homo sapiens
  misc_feature: HIJSMM301DRS8H.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactagtggctgcaccatctgtcttcta

SEQ ID NO: 583785 - DNA, 487 bp, Homo sapiens
  misc_feature: HIJSMM301BMON4.13.87.H10.1.454.light.4.raw
tcacgtactacacgaccggtgctcgatttagcagtactgcgttgggtttggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgagattttgcaacttattactgtcaacagcttaatagttacccgctcagtttcggcggaggaccaaggtggagatcaaacgaactgtggctgcaccatctgtcttcta

SEQ ID NO: 583786 - DNA, 447 bp, Homo sapiens; identical to SEQ ID NO: 535201
  misc_feature: HIJSMM301CKAYW.18.9.A09.1.454.light.4.raw

SEQ ID NO: 583787 - DNA, 495 bp, Homo sapiens
  misc_feature: HIJSMM301DBP1E.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgttatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcgtcggagggaccgaaggtaggagagtcaaacgaaactagt

SEQ ID NO: 583788 - DNA, 492 bp, Homo sapiens
  misc_feature: HIJSMM301DF3LV.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgctaacttactactgtcagcaggctaacaggctcgcccccaaccttccggccgaggggacacgactggagaattaaacgaactgtggctgcaccatctgtt

SEQ ID NO: 583789 - DNA, 486 bp, Homo sapiens; identical to SEQ ID NO: 535385
  misc_feature: HIJSMM301DIXTP.19.71.G05.1.454.light.4.raw

SEQ ID NO: 583790 - DNA, 476 bp, Homo sapiens
  misc_feature: HIJSMM301DKGJH.48.34.D01.1.454.light.4.raw
agtatacatacacgaccggtgctcgatttagatcgtctgtgttgggtttggggtggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctcgtgggacgacactcactctgactatcagtgaagtccgggcagaagacgaggctgactactattgtcagtcaggagacaatactcgcacgcaagtactgttcggcggagggaccaag

SEQ ID NO: 583791 - DNA, 494 bp, Homo sapiens; identical to SEQ ID NO: 534992
  misc_feature: HIJSMM301B1WQM.9.1.A01.1.454.light.4.raw

SEQ ID NO: 583792 - DNA, 494 bp, Homo sapiens; identical to SEQ ID NO: 550126
  misc_feature: HIJSMM301CO5GL.51.35.D02.1.454.light.4.raw

SEQ ID NO: 583793 - DNA, 488 bp, Homo sapiens; identical to SEQ ID NO: 542120
  misc_feature: HIJSMM301BR2GT.47.38.D05.1.454.light.4.raw

SEQ ID NO: 583794 - DNA, 447 bp, Homo sapiens; identical to SEQ ID NO: 535201
  misc_feature: HIJSMM301CNQAJ.18.9.A09.1.454.light.4.raw

SEQ ID NO: 583795 - DNA, 486 bp, Homo sapiens; identical to SEQ ID NO: 535458
  misc_feature: HIJSMM301BASO7.7.75.G09.1.454.light.4.raw

SEQ ID NO: 583796 - DNA, 508 bp, Homo sapiens; identical to SEQ ID NO: 554680
  misc_feature: HIJSMM301BY3RO.47.85.H08.1.454.light.4.raw

SEQ ID NO: 583797 - DNA, 486 bp, Homo sapiens
  misc_feature: HIJSMM301DZV1V.52.25.C03.1.454.light.4.raw
cgcagtacgacacgaccggtgctcgatttagtagtgtagatttgggtttggggcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcagttatttagcctggtatcagcaaaaaccagggaaagcccctaagctcctgatctatggtgcatcaactttgcaaggtgggtcccatcaaggttcagcggcagtggatctgggacagaattcactctcacaatcagcagcctgcagcctgaagattttgcaacttattactgtcaacaccttaatagttactccttcactttcggccctgggaccaaagtggacatcaaacgaactgtggctgcaccatctgtctt

SEQ ID NO: 583798 - DNA, 479 bp, Homo sapiens
  misc_feature: HIJSMM301CI9XH.48.30.C08.1.454.light.4.raw
  modified_base (450)..(450): a, c, t, g, unknown or other
agtatacatacacgaccggtgctcgatttagtctgacgtcaaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggngttcggcggaggaccaagctgactgtccg

SEQ ID NO: 583799 - DNA, 499 bp, Homo sapiens; identical to SEQ ID NO: 564379
  misc_feature: HIJSMM301BIKFB.12.37.D04.1.454.light.4.raw

SEQ ID NO: 583800 - DNA, 503 bp, Homo sapiens; identical to SEQ ID NO: 538884
  misc_feature: HIJSMM301CG90M.27.78.H01.1.454.light.4.raw

SEQ ID NO: 583801 - DNA, 513 bp, Homo sapiens
  misc_feature: HIJSMM301B3YLI.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggaccccaggtggagatcagactgatattaacagcgaaaagagatttttgttaaggggaaagtaatgaagttaa

SEQ ID NO: 583802 - DNA, 504 bp, Homo sapiens
  misc_feature: HIJSMM301B79Y2.9.53.E09.1.454.light.4.raw
tgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggggggaccaaggtgaccgtcctaggtcagcccaaggctgccccctcc

SEQ ID NO: 583803 - DNA, 513 bp, Homo sapiens
  misc_feature: HIJSMM301BCEY0.48.14.B03.1.454.light.4.raw
  modified_base (503)..(503): a, c, t, g, unknown or other
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaagggacccgggtggaaataaaacgaaactgtggctgcaccactntgtcttcatt

SEQ ID NO: 583804 - DNA, 504 bp, Homo sapiens
  misc_feature: HIJSMM301AX672.40.67.G01.1.454.light.4.raw
tctagcgactcacgaccggtgctcgatttagagtatacatattgggtttggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacggactgtggctgcaccatctgtcttcatcttcccgcc

SEQ ID NO: 583805 - DNA, 507 bp, Homo sapiens
  misc_feature: HIJSMM301CFKLK.48.53.E09.1.454.light.4.raw
agtatacatacacgaccggtgctcgatttagagagagtgtgttgggtttgggggaggaactgctcagttaggacccagacggaaccatggaagccccagcgcagcttctcttcctcctgctactctggctcccagattccactggacaaatagtgatgacgcagtccccagccaccctgtctgtgtctccaggggaaagagtcaccctctcctgcagggccagtgagagtcttgacagctccttagcctggtaccaacaaaggcctggccagcctcccaggctcctcatttatgatacatccaccagggccactggtgtcccagccaggttcactggcggtgggtctgggacagagttcactctcaccatcagcagcctgcagtctgaagattttacattttattactgtcagcagtatcgtaagtggactccgacgtttggccaagggaccaaggtggaagtcaaacgaactgtggctgcaccatctgtcttcatcttcccgccta

SEQ ID NO: 583806 - DNA, 511 bp, Homo sapiens; identical to SEQ ID NO: 545382
  misc_feature: HIJSMM301AMOX9.15.34.D01.1.454.light.4.raw

SEQ ID NO: 583807 - DNA, 493 bp, Homo sapiens; identical to SEQ ID NO: 540127
  misc_feature: HIJSMM301DR6G4.10.17.B06.1.454.light.4.raw

SEQ ID NO: 583808 - DNA, 508 bp, Homo sapiens
  misc_feature: HIJSMM301BDW45.53.49.E05.1.454.light.4.raw
cgcgtatacacacgaccggtgctcgatttagagcgactagcaacacacaaaggggctgggcctaaggaagcagcactggtggtgcctcagccatggcctggaccgttctcctcctcggcctcctctctcactgcacagactctgtgacctcctatgtgctgactcaggcaccctcgctgtctgtggccccaggacagacggccaggattgcttgtgggggaaacaacgttggaagtaacagtgtgcattggtaccagcagaagccacgccaggcccctgtcctggtcttctttgatcatggagaccggccctcagggatccctgagcgattctctggctccaagtctgggaacacggccactttgaccatcatcagggtcgaaggccggggatgaggccgactactactgtcagctgtgggacagtagtattcatcagggggcattcggcggagggaccaagctgaccgtcctgggtcagcccgaaggctcgccccctcggtcactcc

SEQ ID NO: 583809 - DNA, 447 bp, Homo sapiens
  misc_feature: HIJSMM301CCFWU.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcagcatcaactgcactgggaccagttccaacatcggggcaaattatgatgtacactggtaccagcaacttccaggaacagcccccaaacttgtcatctatggtaacaataatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccctcctccatactcgta

SEQ ID NO: 583810 - DNA, 493 bp, Homo sapiens
  misc_feature: HIJSMM301B81U2.48.57.F02.1.454.light.4.raw
agtatacatacacgaccggtgctcgatttagctcgatatagttgggtttgggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctg

SEQ ID NO: 583811 - DNA, 506 bp, Homo sapiens
  misc_feature: HIJSMM301AZEO3.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaacatcattggaggtgttagtgtacactggtaccagcagaagccaggccaggcccctgtgctggtcctccatcatactagcgaccggccctcagggatccctgagcgattctcaggctccaactctgggaaaacggccacctgaccatcagcagggtcgaagccggggatgaggccgactattactgtcaggtgtgggctggtgataatgatcatggcgggggtgttcggcggagggaccaagctgaccgtcctaagtcagcccaaggctgccccctggtcactctcg

SEQ ID NO: 583812 - DNA, 515 bp, Homo sapiens
  misc_feature: HIJSMM301CTZXJ.49.11.A11.1.454.light.4.raw
  modified_base (500)..(500): a, c, t, g, unknown or other
agtcgagagacacgaccggtgctcgatttagctacgactgcagggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggcaccctgaccatcagccgggtcgaagacggggatgaggccgactattactgtcaggtgtgggataggtggtagtggtgtcgtcttcggagctgggaccagggtcaccgtcctaggtcagcccaaggccaaccccactgtcactctcgttcccnccctcctctctctcg

SEQ ID NO: 583813 - DNA, 492 bp, Homo sapiens; identical to SEQ ID NO: 540439
  misc_feature: HIJSMM301BEILG.49.28.C06.1.454.light.4.raw

SEQ ID NO: 583814 - DNA, 511 bp, Homo sapiens
  misc_feature: HIJSMM301CO6W2.48.23.C01.1.454.light.4.raw
agtatacatacacgaccggtgctcgatttagtacacgtgattagggattggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctccccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtcctaggtcaacccaaggctgccccccg

SEQ ID NO: 583815 - DNA, 497 bp, Homo sapiens; identical to SEQ ID NO: 544443
  misc_feature: HIJSMM301AE8ZJ.51.39.D06.1.454.light.4.raw

SEQ ID NO: 583816 - DNA, 522 bp, Homo sapiens
  misc_feature: HIJSMM301DS8TF.7.86.H09.1.454.light.4.raw
  modified_base (210)..(210): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgtttacgtccccgtggacgttcggccaagggtaccaaggtggcaatcaaccgaactagtggctgcaccatctgtcttcactcttccccg

SEQ ID NO: 583817 - DNA, 520 bp, Homo sapiens; identical to SEQ ID NO: 535686
  misc_feature: HIJSMM301ELH7X.41.19.B08.1.454.light.4.raw

SEQ ID NO: 583818 - DNA, 508 bp, Homo sapiens
  misc_feature: HIJSMM301D0BWP.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaatacaaacgaactagtggctgcaccatctgtcttcactcttccccg

SEQ ID NO: 583819 - DNA, 507 bp, Homo sapiens
  misc_feature: HIJSMM301AMH9R.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgattttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccaccct

SEQ ID NO: 583820 - DNA, 485 bp, Homo sapiens
  misc_feature: HIJSMM301EHYIA.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccaggatcacctgctctggagataaattgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtcctggtcagccaaggctgcccccg

SEQ ID NO: 583821 - DNA, 510 bp, Homo sapiens
  misc_feature: HIJSMM301D2RH0.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggccaaccccactgtcactctgttcccgccctcctccgtgtctgat

SEQ ID NO: 583822 - DNA, 516 bp, Homo sapiens; identical to SEQ ID NO: 574977
  misc_feature: HIJSMM301D7AZO.9.38.D05.1.454.light.4.raw

SEQ ID NO: 583823 - DNA, 513 bp, Homo sapiens
  misc_feature: HIJSMM301D5N37.43.23.C01.1.454.light.4.raw
tgtgagtagtcacgaccggtgctcgatttagtacacgtgattagggattggggtctggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccacct

SEQ ID NO: 583824 - DNA, 485 bp, Homo sapiens; identical to SEQ ID NO: 545103
  misc_feature: HIJSMM301AIJ0D.5.42.D09.1.454.light.4.raw

SEQ ID NO: 583825 - DNA, 495 bp, Homo sapiens
  misc_feature: HIJSMM301ETG32.40.50.E06.1.454.light.4.raw
tctagcgactcacgaccggtgctcgatttagatctactgacaacacacaagggggctggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggagacaccggtgatattgggacttataaccttgtctcttggtaccaacagcacccaggcaaagcccccaaacttatgatttatgagggcagccagcggccctcatggatttctagtcgcttctctgcctccaagtctggcaacacggcctccctgacaatctctggactccaggctgaggacgaggctgagtattactgctgcgcatttgcaggtagtagcgccccttatgtcttcgggactgggaccaaggtcacagtcctaggtcagcccc

SEQ ID NO: 583826 - DNA, 478 bp, Homo sapiens; identical to SEQ ID NO: 566620
  misc_feature: HIJSMM301C69Z2.4.33.C11.1.454.light.4.raw

SEQ ID NO: 583827 - DNA, 466 bp, Homo sapiens; identical to SEQ ID NO: 535366
  misc_feature: HIJSMM301AO9LZ.13.4.A04.1.454.light.4.raw

SEQ ID NO: 583828 - DNA, 512 bp, Homo sapiens
  misc_feature: HIJSMM301BC6M0.48.34.D01.1.454.light.4.raw
agtatacatacacgaccggtgctcgatttagatcgtctgtgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagccaacggctcgccccctcggtcactctgttcccacct

SEQ ID NO: 583829 - DNA, 518 bp, Homo sapiens; identical to SEQ ID NO: 580721
  misc_feature: HIJSMM301ET145.43.59.F04.1.454.light.4.raw

SEQ ID NO: 583830 - DNA, 521 bp, Homo sapiens
  misc_feature: HIJSMM301C7XWW.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataaacctgcaaatctgacgactttgcagtttaatttcttgtcagcagtctgaagactggccgttcacttcggtcggagggaccgaaggtaggacgccaaacgaaactagtggctgcaccaactctgtcttcctatcttcccgtccact

SEQ ID NO: 583831 - DNA, 505 bp, Homo sapiens
  misc_feature: HIJSMM301EGIZ7.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 583832 - DNA, 507 bp, Homo sapiens
  misc_feature: HIJSMM301BP4SS.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccccatgt

SEQ ID NO: 583833 - DNA, 485 bp, Homo sapiens
  misc_feature: HIJSMM301BSP3Q.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttcggccagggacacgactggagataaacgaactgtggctgcaccatctgtt

SEQ ID NO: 583834 - DNA, 491 bp, Homo sapiens
  misc_feature: HIJSMM301AKP2R.52.9.A09.1.454.light.4.raw
cgcagtacgacacgaccggtgctcgatttagcgagacgcgcaggggtgatcaggactcctcagttcaccttctcacaatgaggctccctgctcagctcctggggctgctaatgctctgggtctctggatccagtggggagattgtgatgactcagtctccactctccctgcccgtcacccctggagagacggcctccatctcctgcaggtctagtcagagcctcctgcatagtaatggatacaagtatttggattggtatctgcagaagccagggcagtctccacagctcctgatctatttgggttctaatcgggcctccggggtccctgagaggttcagtggcagtggatcaggcacagattttacactaaaaatcagcagagtggaggctgaggatgttggggtttagttactgcatgcaagttctacaaaatacctcgcacttttggtccgaggggaccgaagactggaggatcaaacgaactagtgg

SEQ ID NO: 583835 - DNA, 469 bp, Homo sapiens; identical to SEQ ID NO: 536091
  misc_feature: HIJSMM301BILUM.3.82.H05.1.454.light.4.raw

SEQ ID NO: 583836 - DNA, 508 bp, Homo sapiens; identical to SEQ ID NO: 535835
  misc_feature: HIJSMM301DNU6U.8.34.D01.1.454.light.4.raw

SEQ ID NO: 583837 - DNA, 521 bp, Homo sapiens; identical to SEQ ID NO: 562813
  misc_feature: HIJSMM301C1XSB.10.86.H09.1.454.light.4.raw

SEQ ID NO: 583838 - DNA, 523 bp, Homo sapiens
  misc_feature: HIJSMM301DSLGN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggcgtgaccgtcctaggtcagcccaaggctgccccctcggtcactctgttcccgccct

SEQ ID NO: 583839 - DNA, 504 bp, Homo sapiens
  misc_feature: HIJSMM301CZ1FB.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtcctacagcctgaagattttgcgacttactattgtcaacagagttaccttctcccccggacgttcgccgaacggaccaacggtaggaagtacaagcgaactcgtggctggcaccgactctgtcttc

SEQ ID NO: 583840 - DNA, 486 bp, Homo sapiens; identical to SEQ ID NO: 535043
  misc_feature: HIJSMM301BR6DE.46.35.D02.1.454.light.4.raw

SEQ ID NO: 583841 - DNA, 517 bp, Homo sapiens
  misc_feature: HIJSMM301AMMFR.48.34.D01.1.454.light.4.raw
agtatacatacacgaccggtgctcgatttagatcgtctgtgttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgatgtcactaagcggccctcgggggtccctgatcgcttctctggctccaagtctggcaacacggcctccctgaccatctctgggctccaggctgaagatcaggctgattattactgctgttcattttcaagttcctttttgtcttcggaactgggaccgaggtcaccgtcctaggtcagcccaaggccaaccccactgtcactctgttcccta

SEQ ID NO: 583842 - DNA, 515 bp, Homo sapiens
  misc_feature: HIJSMM301B8WH9.15.86.H09.1.454.light.4.raw
tctacgtagccacgaccggtgctcgatttagtgctatagacttgggtttggggggacgttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaaggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctcggtcactctgttcccaccctcctcgctacgtagacg

SEQ ID NO: 583843 - DNA, 486 bp, Homo sapiens
  misc_feature: HIJSMM301DL8IT.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttaatgtcttcggatctgggaccagggtcaccgtcctaggtcagcccaaggccaa

SEQ ID NO: 583844 - DNA, 513 bp, Homo sapiens
  misc_feature: HIJSMM301EK2SR.7.39.D06.1.454.light.4.raw
cgtgtctctacacgaccggtgctcgatttagtgacatctcgcagttctttgggggtgggctcaggaggcagagctctgggaatctcaccatggcctggacccctctcctgctccccctcctcactttctgcacagtctctgaggcctcctatgaactgacacagccaccctcggtgtcagtgtccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctcggtcactctgttcccgccct

SEQ ID NO: 583845 - DNA, 513 bp, Homo sapiens
  misc_feature: HIJSMM301BE9XK.5.58.F03.1.454.light.4.raw
atcagacacgcacgaccggtgctcgatttagtctgatcgagaagggaaagggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcagggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccccactgtcactcttcg

SEQ ID NO: 583846 - DNA, 521 bp, Homo sapiens; identical to SEQ ID NO: 538715
  misc_feature: HIJSMM301DX9DZ.27.23.C01.1.454.light.4.raw

SEQ ID NO: 583847 - DNA, 505 bp, Homo sapiens
  misc_feature: HIJSMM301BDTWI.13.81.H04.1.454.light.4.raw
tcacgtactacacgaccggtgctcgatttagtagtgtagattcgcgggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaaccccactgtcactctccg

SEQ ID NO: 583848 - DNA, 517 bp, Homo sapiens
  misc_feature: HIJSMM301AUO5J.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaaagcggggacccagaccctggagcctcagttggaagcagccgatccagcctgcggagcctgtggggcaggtcagcccaaaggccaacccccactgtcact

SEQ ID NO: 583849 - DNA, 464 bp, Homo sapiens
  misc_feature: HIJSMM301BJ3HM.10.9.A09.1.454.light.4.raw
catagtagtgcacgaccggtgctcgatttagcgagacgcgcagggggaggaactgctcagttaggacccagagggaaccatggaagccccagctcagcttctcttcctcctgctactctggctcccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaagtggagatcaaacgaactgtggctgcaccatctgtcttcatcttcccgccactctgacactactatg

SEQ ID NO: 583850 - DNA, 513 bp, Homo sapiens
  misc_feature: HIJSMM301ERVNJ.15.76.G10.1.454.light.4.raw
tctacgtagccacgaccggtgctcgatttagtcactcatacaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaaagtcagcccaaggctgccccctcggtcactctgtcccacctcctcgctacg

SEQ ID NO: 583851 - DNA, 478 bp, Homo sapiens
  misc_feature: HIJSMM301BYVQZ.48.40.D07.1.454.light.4.raw
agtatacatacacgaccggtgctcgatttagtgatagagcgtaacaacagaggggactgatcaggactcctcagttcaccttctcacaatgtggctccctgctcagctcctggggctgctaatgctctgggtctctggatccagtggggaaattgtgatgactcagtctccactctccctgcccgtcacccctggagagccggcctccatctcctgcaggtctagtcagagtctcctgcatagtaatggatacaattatttggattggtatttgcagaagccagggcagtctccacagctcctgatctatttgggttctaatcgggcctccggggtccctgacaggttcagtggccatggatcaggcacagatttcacactgaaaatcagcagagtggaggctgaggatgttggagtttactactgcatgcaagctctgcatactgctcggacgttcggccaagggaccaaggtggag

SEQ ID NO: 583852 - DNA, 471 bp, Homo sapiens; identical to SEQ ID NO: 546836
  misc_feature: HIJSMM301CNQPH.18.76.G10.1.454.light.4.raw

SEQ ID NO: 583853 - DNA, 472 bp, Homo sapiens
  misc_feature: HIJSMM301ENXD8.52.59.F04.1.454.light.4.raw
cgcagtacgacacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgccctcacacgttcggccaagggaccaagctggaaatcaaacgaa

SEQ ID NO: 583854 - DNA, 495 bp, Homo sapiens
  misc_feature: HIJSMM301ETKCJ.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactggaccacggtcaccgtcctaggtcagcccaaggccaacccca

SEQ ID NO: 583855 - DNA, 483 bp, Homo sapiens; identical to SEQ ID NO: 561886
  misc_feature: HIJSMM301CGPKA.40.83.H06.1.454.light.4.raw

SEQ ID NO: 583856 - DNA, 510 bp, Homo sapiens; identical to SEQ ID NO: 542037
  misc_feature: HIJSMM301AFS5S.4.57.F02.1.454.light.4.raw

SEQ ID NO: 583857 - DNA, 509 bp, Homo sapiens; identical to SEQ ID NO: 539359
  misc_feature: HIJSMM301D7QZF.47.85.H08.1.454.light.4.raw

SEQ ID NO: 583858 - DNA, 500 bp, Homo sapiens; identical to SEQ ID NO: 542309
  misc_feature: HIJSMM301BR8IA.12.86.H09.1.454.light.4.raw

SEQ ID NO: 583859 - DNA, 518 bp, Homo sapiens; identical to SEQ ID NO: 579925
  misc_feature: HIJSMM301BRK07.14.78.H01.1.454.light.4.raw

SEQ ID NO: 583860 - DNA, 490 bp, Homo sapiens
  misc_feature: HIJSMM301A3LNV.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaactttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggaggatcaaacgaa

SEQ ID NO: 583861 - DNA, 489 bp, Homo sapiens; identical to SEQ ID NO: 535139
  misc_feature: HIJSMM301CXJSN.14.55.E11.1.454.light.4.raw

SEQ ID NO: 583862 - DNA, 487 bp, Homo sapiens; identical to SEQ ID NO: 565744
  misc_feature: HIJSMM301CILJ5.49.76.G10.1.454.light.4.raw

SEQ ID NO: 583863 - DNA, 510 bp, Homo sapiens
  misc_feature: HIJSMM301E1BA3.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctctttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggttttttggcggtcgggacccagatgactgtcctcagtcagcccaaggctgccccctcggt

SEQ ID NO: 583864 - DNA, 464 bp, Homo sapiens
  misc_feature: HIJSMM301CJX2K.43.75.G09.1.454.light.4.raw
tgtgagtagtcacgaccggtgctcgatttagtatagacatcagggggaatcagacccagtcaggacacagcatggacatgagagtcctcgctcagctcctggggctcctgctgctctgtttcccaggtgccagatgtgacatccagatgacccagtctccatcctcactgtctgcatctgtgggagacagggtcaccttcacttgtcgggcgagtcagcgcattagcaattatttagcctggtttcagcagaaaccagggaaagcccctcagtccctgatctatgctgcattcaatttgcatagtggcgtcccatcaagattcagcgccagtggatctgggatagctttcactctcaccatcgccagcctgcagcccgaagattttgcaacttattactgccaacagtatgatgattacccgtacacttttggccagggccaagctggagatcaatcgaactgt

SEQ ID NO: 583865 - DNA, 447 bp, Homo sapiens; identical to SEQ ID NO: 535020
  misc_feature: HIJSMM301B73MA.18.9.A09.1.454.light.4.raw

SEQ ID NO: 583866 - DNA, 494 bp, Homo sapiens; identical to SEQ ID NO: 534994
  misc_feature: HIJSMM301CKXPZ.27.78.H01.1.454.light.4.raw

SEQ ID NO: 583867 - DNA, 494 bp, Homo sapiens; identical to SEQ ID NO: 534994
  misc_feature: HIJSMM301B28CN.27.78.H01.1.454.light.4.raw

SEQ ID NO: 583868 - DNA, 510 bp, Homo sapiens
  misc_feature: HIJSMM301ER90W.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctggaccgtcctaagtcagcccaaggctgccccctc

SEQ ID NO: 583869 - DNA, 515 bp, Homo sapiens; identical to SEQ ID NO: 541016
  misc_feature: HIJSMM301EC1YJ.43.23.C01.1.454.light.4.raw

SEQ ID NO: 583870 - DNA, 486 bp, Homo sapiens; identical to SEQ ID NO: 540808
  misc_feature: HIJSMM301EJCRK.26.70.G04.1.454.light.4.raw

SEQ ID NO: 583871 - DNA, 520 bp, Homo sapiens
  misc_feature: HIJSMM301EBN9N.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccacgggaccgaacggtaggaaggtacaaacgaactacgtggcgtgcgaccactctgtcttctatcttcccgtcccact

SEQ ID NO: 583872 - DNA, 469 bp, Homo sapiens; identical to SEQ ID NO: 536091
  misc_feature: HIJSMM301DBF39.3.82.H05.1.454.light.4.raw

SEQ ID NO: 583873 - DNA, 492 bp, Homo sapiens; identical to SEQ ID NO: 534967
  misc_feature: HIJSMM301D27N3.47.64.F09.1.454.light.4.raw

SEQ ID NO: 583874 - DNA, 494 bp, Homo sapiens; identical to SEQ ID NO: 553467
  misc_feature: HIJSMM301ELVU1.13.67.G01.1.454.light.4.raw

SEQ ID NO: 583875 - DNA, 495 bp, Homo sapiens
  misc_feature: HIJSMM301B4OIB.7.5.A05.1.454.light.4.raw
cgtgtctctacacgaccggtgctcgatttagatagatagacagggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccgaatcgcttctctggctccaagtctggcgacacggcctccctgaccatctctgggctccaggctgaagacgaggctgattattactgcagctcatatacaggcagcagcactcaggttttcgcggagggaccaagctgaccgtcctaggtcagcccaaggctgccccctcggt

SEQ ID NO: 583876 - DNA, 477 bp, Homo sapiens
  misc_feature: HIJSMM301ANFCY.3.1.A01.1.454.light.4.raw
agacgcactccacgaccggtgctcgatttagacgtctcatcaggggagactcagtcaggacacagcatggacatgtaggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatacaaacgaactgtggctgcaccatctgtctt

SEQ ID NO: 583877 - DNA, 502 bp, Homo sapiens; identical to SEQ ID NO: 543597
  misc_feature: HIJSMM301A8Y8C.15.25.C03.1.454.light.4.raw

SEQ ID NO: 583878 - DNA, 493 bp, Homo sapiens; identical to SEQ ID NO: 571339
  misc_feature: HIJSMM301BW1XD.10.72.G06.1.454.light.4.raw

SEQ ID NO: 583879 - DNA, 503 bp, Homo sapiens
  misc_feature: HIJSMM301A872G.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataatttggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcgggagggaccgagtctgaccgtcctaggtcagcccaaggctgccccctcggtcactcttccg

SEQ ID NO: 583880 - DNA, 486 bp, Homo sapiens; identical to SEQ ID NO: 542999
  misc_feature: HIJSMM301D3Z6J.17.55.E11.1.454.light.4.raw

SEQ ID NO: 583881 - DNA, 477 bp, Homo sapiens; identical to SEQ ID NO: 540087
  misc_feature: HIJSMM301C9DI5.52.73.G07.1.454.light.4.raw

SEQ ID NO: 583882 - DNA, 522 bp, Homo sapiens
  misc_feature: HIJSMM301CP919.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactcctgttcccaccct

SEQ ID NO: 583883 - DNA, 496 bp, Homo sapiens; identical to SEQ ID NO: 536033
  misc_feature: HIJSMM301CA87A.10.79.H02.1.454.light.4.raw

SEQ ID NO: 583884 - DNA, 504 bp, Homo sapiens; identical to SEQ ID NO: 538521
  misc_feature: HIJSMM301BX62I.9.12.B01.1.454.light.4.raw

SEQ ID NO: 583885 - DNA, 512 bp, Homo sapiens
  misc_feature: HIJSMM301DD2T7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagttgtcccccggacgttcggtccacgggaccgacacgtagaaatagagacgaactacgtggcgtgcaccactctgtcttctactcttcccgt

SEQ ID NO: 583886 - DNA, 502 bp, Homo sapiens; identical to SEQ ID NO: 543913
  misc_feature: HIJSMM301C87H6.18.26.C04.1.454.light.4.raw

SEQ ID NO: 583887 - DNA, 479 bp, Homo sapiens; identical to SEQ ID NO: 535188
  misc_feature: HIJSMM301D18BQ.10.74.G08.1.454.light.4.raw

SEQ ID NO: 583888 - DNA, 498 bp, Homo sapiens
  misc_feature: HIJSMM301DYXZQ.9.67.G01.1.454.light.4.raw
tgatacgtctcacgaccggtgctcgatttagagtatacatattgggtttgggggaggaactgctcagttaggacccagacggaaccatggaagccccagcgcagcttctcttcctcctgctactctggctcccagataccactggaataatagtgatgacgcagtctccagccgaccctgtctgtgtttccaggagaaacagccactctcacctgcagggccagtcagagtcttggcaccaacttagcctggtaccagcagagacctggcttggctcccagggtcctcatctacggtgcgtccagcagggccactggtatcccggccaggttcagtggtagtgggtctgggacagagttcgttctcaccatcagcagcctgcagtctgaagattttgcagtttattactgtcagcactataatagttggccgctcactttcggcggagggaccaaggtggagctcaaacgaactgtggctgcaccatctgtcttcatt

SEQ ID NO: 583889 - DNA, 475 bp, Homo sapiens
  misc_feature: HIJSMM301D3E2K.48.37.D04.1.454.light.4.raw
agtatacatacacgaccggtgctcgatttagtagcatactgttgggtttgggggatacgcgtgacagataagaagggctggtgggatcagtcctggtggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgat

SEQ ID NO: 583890 - DNA, 506 bp, Homo sapiens
  misc_feature: HIJSMM301DLCTJ.8.33.C11.1.454.light.4.raw
ctcgcgtgtccacgaccggtgctcgatttagagtgagctcgttgggtttggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcta

SEQ ID NO: 583891 - DNA, 490 bp, Homo sapiens; identical to SEQ ID NO: 548025
  misc_feature: HIJSMM301D4BSZ.13.39.D06.1.454.light.4.raw

SEQ ID NO: 583892 - DNA, 508 bp, Homo sapiens
  misc_feature: HIJSMM301BKPAW.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagttttattactgtcaaactgttttctcgggcgttcgccgaagggaaccgaaggtaggaatacaaacgaactgtggctgcaccatctgtcttctatcttccccg

SEQ ID NO: 583893 - DNA, 506 bp, Homo sapiens
  misc_feature: HIJSMM301C5VCN.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatccacgggacgcaacatggggatgacaatctgagcggttgggtgttcggcggagggaccaaactgaccgtcctagggtcagccccaa

SEQ ID NO: 583894 - DNA, 523 bp, Homo sapiens
  misc_feature: HIJSMM301D2V9R.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcgggcggagggaccaggctgaccgtcctaggtcagcccaaggctgccccctcggtcactctcgttcccgccct

SEQ ID NO: 583895 - DNA, 499 bp, Homo sapiens; identical to SEQ ID NO: 535899
  misc_feature: HIJSMM301BQJVC.19.78.H01.1.454.light.4.raw

SEQ ID NO: 583896 - DNA, 492 bp, Homo sapiens
  misc_feature: HIJSMM301BKI2F.41.23.C01.1.454.light.4.raw
tctatactatcacgaccggtgctcgatttagtacacgtgattagggattgggggagtcagacccagtcaggacacagcatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaattttattttgtcaacaggctaataggttcctcaaacattcggccctgggaccagagtggatttgaagcgaactgtgctgcaccatctgtcttcta

SEQ ID NO: 583897 - DNA, 472 bp, Homo sapiens
  misc_feature: HIJSMM301AE501.52.43.D10.1.454.light.4.raw
cgcagtacgacacgaccggtgctcgatttagactagcagtaaggggagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccgaaggtggagatcaagcgaactgtggctgcaccat

SEQ ID NO: 583898 - DNA, 521 bp, Homo sapiens
  misc_feature: HIJSMM301CDAYM.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttccgccct

SEQ ID NO: 583899 - DNA, 487 bp, Homo sapiens; identical to SEQ ID NO: 535583
  misc_feature: HIJSMM301D3747.22.73.G07.1.454.light.4.raw

SEQ ID NO: 583900 - DNA, 524 bp, Homo sapiens
  misc_feature: HIJSMM301CTGBW.12.73.G07.1.454.light.4.raw
atacgacgtacacgaccggtgctcgatttagctctacgctcaggggctgggcccaaggaagcagcactggtggtgcctcagccatggcctggaccgttctcctcctcggcctcctctctcactgcacagcctctgtgacctcctatgtactgattcagtcgccctcggtgtcagtggccccaggacagacggccacgattacctgtggaggagacaatattgtcaccaaaagtgttcactggtaccagcagaagccaggccaggcccctgtggtggtcgtctatgatgatagcgaccggccctcggggatccctgagcgattctctggctccaactctgggaacatggccaccctgaccatccgcagggtcgaggccggggatgaggccgactattattgtcaggtgtgggataatggcagtgatcatgtcttattcggcggaggaccacgcgtgaccggtcctaacgtacagcccaacggacgtcgccccctcccggtccgacctcctcgttccctacccctt

SEQ ID NO: 583901 - DNA, 460 bp, Homo sapiens; identical to SEQ ID NO: 539553
  misc_feature: HIJSMM301BUYTK.11.86.H09.1.454.light.4.raw

SEQ ID NO: 583902 - DNA, 498 bp, Homo sapiens
  misc_feature: HIJSMM301EPM30.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtagggataatcagacgaaactgtggct

SEQ ID NO: 583903 - DNA, 518 bp, Homo sapiens; identical to SEQ ID NO: 539372
  misc_feature: HIJSMM301DGUF5.7.86.H09.1.454.light.4.raw

SEQ ID NO: 583904 - DNA, 478 bp, Homo sapiens; identical to SEQ ID NO: 535129
  misc_feature: HIJSMM301AFQ6O.11.11.A11.1.454.light.4.raw

SEQ ID NO: 583905 - DNA, 517 bp, Homo sapiens; identical to SEQ ID NO: 541775
  misc_feature: HIJSMM301BNYAW.5.27.C05.1.454.light.4.raw

SEQ ID NO: 583906 - DNA, 491 bp, Homo sapiens; identical to SEQ ID NO: 579692
  misc_feature: HIJSMM301B4SD6.14.55.E11.1.454.light.4.raw

SEQ ID NO: 583907 - DNA, 475 bp, Homo sapiens
  misc_feature: HIJSMM301EUNGP.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattatgtcagcaatatggtacttcaccccggacgtcgtcacgacgacgacggagagaacgaataacgtagacgtgc

SEQ ID NO: 583908 - DNA, 531 bp, Homo sapiens
  misc_feature: HIJSMM301D9C9R.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctccatctatggtgcatccaacagggccactggcatcccagccaggttcagtggcagtgggtctgggacagacttcactctcaccatcatcagcctggagcctgaagatgttgcagtttattactgtcaacatcgtaccgagtggcccggccgggcctcgttccgtccggtcggaaaccgtaaggtagagtactaaccgaaacgtaacgtggtcggtcgtcgaccaccactcgtcttctta

SEQ ID NO: 583909 - DNA, 490 bp, Homo sapiens
  misc_feature: HIJSMM301EEDRX.43.77.G11.1.454.light.4.raw
tgtgagtagtcacgaccggtgctcgatttagctagtcactcaagggaaaggggctgcttcagctgtgggcacaagaggcagcactcaggacagtctccagcatggcctggtcttctctcctcctcactctcctcgctcactgcacagggtcctgggcccagtctgtgctgacgcagccgccctcagtgtctggggccccagggcagagggtcaccatcccctgtactgggagcagtttcaacatcggggcaggtttggatgttaactggtaccagcaacttccaggatcagcccccaaactcctcatctatggtaccaccaatcggccctcaggagtccctgaccgattctctggctccaagtctggcatctcagccttcctggccatcactggactccaggtcgaggatgaggctgattattactgccaggcctgggacatcagcctgagtggccattatgtcttcggaaccgcgaccaaggtcaccgt

SEQ ID NO: 583910 - DNA, 483 bp, Homo sapiens
  misc_feature: HIJSMM301AYJ4B.19.71.G05.1.454.light.4.raw
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtatcagacgaa

SEQ ID NO: 583911 - DNA, 486 bp, Homo sapiens; identical to SEQ ID NO: 535917
  misc_feature: HIJSMM301B27L3.3.10.A10.1.454.light.4.raw

SEQ ID NO: 583912 - DNA, 521 bp, Homo sapiens; identical to SEQ ID NO: 539470
  misc_feature: HIJSMM301AF70W.27.23.C01.1.454.light.4.raw

SEQ ID NO: 583913 - DNA, 504 bp, Homo sapiens; identical to SEQ ID NO: 538940
  misc_feature: HIJSMM301BUR10.2.35.D02.1.454.light.4.raw

SEQ ID NO: 583914 - DNA, 524 bp, Homo sapiens
  misc_feature: HIJSMM301DYD3K.43.81.H04.1.454.light.4.raw
  modified_base (500)..(500): a, c, t, g, unknown or other
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctcctactttcgtactcgcctgggtcgttcgggcgggggactcagttgaccgtcctaggtcacgcccaaggctcgccccctcggtcnctctcgttcccaccctcctcacta

SEQ ID NO: 583915 - DNA, 496 bp, Homo sapiens
  misc_feature: HIJSMM301B4N7F.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccaagctggaaatcaagcgaactgtggctgcaccatctgtcttcattccc

SEQ ID NO: 583916 - DNA, 501 bp, Homo sapiens
  misc_feature: HIJSMM301CLMJK.9.21.B10.1.454.light.4.raw
tgatacgtctcacgaccggtgctcgatttagtgtcgtcgcaagagagatggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctcggtcactctgttcccaccctcctc

SEQ ID NO: 583917 - DNA, 484 bp, Homo sapiens; identical to SEQ ID NO: 537427
  misc_feature: HIJSMM301CQCP0.26.78.H01.1.454.light.4.raw

SEQ ID NO: 583918 - DNA, 516 bp, Homo sapiens
  misc_feature: HIJSMM301A3V2R.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgacgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagctgaccgtcctcggtcagcccaaggctgccccctcggtcactctgttcccgccctcct

SEQ ID NO: 583919 - DNA, 484 bp, Homo sapiens; identical to SEQ ID NO: 536162
  misc_feature: HIJSMM301EU0ZP.13.59.F04.1.454.light.4.raw

SEQ ID NO: 583920 - DNA, 497 bp, Homo sapiens
  misc_feature: HIJSMM301AY4I3.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccccgacaggttcagtggcagtggatcaggcacagattttacactgaaaatcagcagagtggaggctgatgagtgtttggggttattactgcatgcaagctactaacaaactccttactactttggccgaggggaccaagcgtggagactacaaacgaacgt

SEQ ID NO: 583921 - DNA, 484 bp, Homo sapiens
  misc_feature: HIJSMM301AKOT3.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacattgaaaatcagcagagtggaggctgaggatgttgggctctattattgcatgcaagctctacaagtcccgctcactttcggcggagggaccaaggtggagatcaaacgaa

SEQ ID NO: 583922 - DNA, 502 bp, Homo sapiens; identical to SEQ ID NO: 539314
  misc_feature: HIJSMM301BYLLO.21.81.H04.1.454.light.4.raw

SEQ ID NO: 583923 - DNA, 488 bp, Homo sapiens
  misc_feature: HIJSMM301A3M3R.9.59.F04.1.454.light.4.raw
tgatacgtctcacgaccggtgctcgatttagtacacacacttagggattgggggcaggagtcagacccagtcaggacacagcatggacatgagggtccccgctcagctcctggggctcctgctgctctggttcccggttcgagatgcgacatccagatgacccagtctccatcttccgtggctgcatctgtgggagactcagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacgaactgtaggctgcaccat

SEQ ID NO: 583924 - DNA, 501 bp, Homo sapiens; identical to SEQ ID NO: 555551
  misc_feature: HIJSMM301EAKXJ.21.81.H04.1.454.light.4.raw

SEQ ID NO: 583925 - DNA, 491 bp, Homo sapiens
  misc_feature: HIJSMM301BPC02.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggccaaggtggaggtcaaacgaactagtggctgcaccatctgtcttcatt

SEQ ID NO: 583926 - DNA, 487 bp, Homo sapiens
  misc_feature: HIJSMM301D6K9M.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaaccttcggccaggggacacgactggagattaaacggaactgtggctgcaccatctgtt

SEQ ID NO: 583927 - DNA, 512 bp, Homo sapiens; identical to SEQ ID NO: 541300
  misc_feature: HIJSMM301D32DO.17.33.C11.1.454.light.4.raw

SEQ ID NO: 583928 - DNA, 500 bp, Homo sapiens
  misc_feature: HIJSMM301EAV1S.43.14.B03.1.454.light.4.raw
tgtgagtagtcacgaccggtgctcgatttagtgtgagtagttccgcgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcgagggtttctaatcgcttctctggctccaagtctggcaacacggcctccctgaccatctctgggctccaggctggaggacgaggctgattattactgcagctcatatacaagcagcagcacttatgtcttcggaactgggaccaaggtcaccgacctaggtcagcccaaggcccaaccc

SEQ ID NO: 583929 - DNA, 494 bp, Homo sapiens; identical to SEQ ID NO: 534994
  misc_feature: HIJSMM301ALQWZ.27.78.H01.1.454.light.4.raw

SEQ ID NO: 583930 - DNA, 482 bp, Homo sapiens; identical to SEQ ID NO: 539800
  misc_feature: HIJSMM301ELWOT.21.25.C03.1.454.light.4.raw

SEQ ID NO: 583931 - DNA, 494 bp, Homo sapiens; identical to SEQ ID NO: 534992
  misc_feature: HIJSMM301DM1AQ.9.1.A01.1.454.light.4.raw

SEQ ID NO: 583932 - DNA, 505 bp, Homo sapiens; identical to SEQ ID NO: 543540
  misc_feature: HIJSMM301C8BF0.9.12.B01.1.454.light.4.raw

SEQ ID NO: 583933 - DNA, 485 bp, Homo sapiens
  misc_feature: HIJSMM301DPOX4.52.83.H06.1.454.light.4.raw
cgcagtacgacacgaccggtgctcgatttagatcacgtgcgtcgcgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaattatttaaattggtatcagcagaaaccagggaaagcccctaaactcctgatctacgatgcatccaatttggaaacaggggtcccatcaaggttcagtggaagtggttctgggacacattttactttcaccatcagcggcctgcagcctgaagatattgcaacatattactgtcaacagtatggtaatctcccactcactttcggcggagggaccaaggtcgagatcaaacgaactgtgctgcacatctgtctt

SEQ ID NO: 583934 - DNA, 478 bp, Homo sapiens
  misc_feature: HIJSMM301D6H7Q.11.17.B06.1.454.light.4.raw
cgagagataccacgaccggtgctcgatttagtcgatagtgaagggggcaggagtcagtctcagtcaggacacagcatggacatgagggtccccgctcagctcctggggctcctgctactctggctccgaggtgccagatgtgacatccagatgacccagtctccgtcctccctgtctgcatctgtaggagacagagtcaccatcacttgccgggcaagtcagatcattagcagctatttaaattggtatcagcagaaaccagggaaagcccctgaggtcctgatctatgctgcatccagtttgcagagtggggtcccatcaaggttcagtggcagtggatctgcgacagatttcactctcaccatcagcagtctgcaacctgaagattttgcaacttactactgtcaacagagttacagtaccccgtggacgttcggccaaggaccaaggtggaaatacaaacgaactagtggctgca

SEQ ID NO: 583935 - DNA, 496 bp, Homo sapiens
  misc_feature: HIJSMM301BYA7D.22.9.A09.1.454.light.4.raw
acatacgcgtcacgaccggtgctcgatttagcgagacgcgcagggggaggaactgctcagttaggacccagaaggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccaggggccaagctggagatcagacgaactgtggctgcaccatctgtcttcatcttccccg

SEQ ID NO: 583936 - DNA, 496 bp, Homo sapiens
  misc_feature: HIJSMM301ETM38.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggcggggggaccgaagctggagatcaaccgaactgtggctgcaccatctgt

SEQ ID NO: 583937 - DNA, 466 bp, Homo sapiens; identical to SEQ ID NO: 536398
  misc_feature: HIJSMM301C9WPW.3.20.B09.1.454.light.4.raw

SEQ ID NO: 583938 - DNA, 486 bp, Homo sapiens; identical to SEQ ID NO: 569188
  misc_feature: HIJSMM301ELKNY.40.86.H09.1.454.light.4.raw

SEQ ID NO: 583939 - DNA, 494 bp, Homo sapiens
  misc_feature: HIJSMM301ATHXO.51.81.H04.1.454.light.4.raw
cgatcgtatacacgaccggtgctcgatttagtagtgtagattcgcggggtgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaaggtcaccgtcctgggtcagcccaaggccaaccccactgtcact

SEQ ID NO: 583940 - DNA, 505 bp, Homo sapiens; identical to SEQ ID NO: 535503
  misc_feature: HIJSMM301DXR7C.8.28.C06.1.454.light.4.raw

SEQ ID NO: 583941 - DNA, 489 bp, Homo sapiens
  misc_feature: HIJSMM301B4R7H.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaagggaccaaggtggatatcagacgaa

SEQ ID NO: 583942 - DNA, 502 bp, Homo sapiens; identical to SEQ ID NO: 543936
  misc_feature: HIJSMM301CCW15.15.1.A01.1.454.light.4.raw

SEQ ID NO: 583943 - DNA, 496 bp, Homo sapiens; identical to SEQ ID NO: 575048
  misc_feature: HIJSMM301BQJI9.26.72.G06.1.454.light.4.raw

SEQ ID NO: 583944 - DNA, 446 bp, Homo sapiens; identical to SEQ ID NO: 536106
  misc_feature: HIJSMM301CEUTZ.18.9.A09.1.454.light.4.raw

SEQ ID NO: 583945 - DNA, 502 bp, Homo sapiens; identical to SEQ ID NO: 541971
  misc_feature: HIJSMM301EOPS4.4.39.D06.1.454.light.4.raw

SEQ ID NO: 583946 - DNA, 510 bp, Homo sapiens
  misc_feature: HIJSMM301DZNRG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggccaagggaccgaaggtggaaatacaaacgaactagtggctgcaccatcctgtcttctactctttccccg

SEQ ID NO: 583947 - DNA, 503 bp, Homo sapiens
  misc_feature: HIJSMM301E1N2X.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtaagtggtacttatgtgcagttcggcggaggaccaagctgaccgtcctaggtcagcccaaggctgccccctcggtcacttccg

SEQ ID NO: 583948 - DNA, 484 bp, Homo sapiens; identical to SEQ ID NO: 537753
  misc_feature: HIJSMM301DZJ9R.41.47.E03.1.454.light.4.raw

SEQ ID NO: 583949 - DNA, 499 bp, Homo sapiens
  misc_feature: HIJSMM301CS5A8.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaaatattatattcctcctcagacgttcggccaagggaccaaggtggaaaatcaaacgaactgtggctgcacca

SEQ ID NO: 583950 - DNA, 509 bp, Homo sapiens
  misc_feature: HIJSMM301B3QJK.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatgggtccgtgttcggcggagggaccaggctgaccgtcctaagtcagcccaaggctgccccctc

SEQ ID NO: 583951 - DNA, 521 bp, Homo sapiens
  misc_feature: HIJSMM301AFYLL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgagattttgcagtatattactgtcagcaatatggtacttcacccccggacgttcggccgacggaccgaacggtaggaaggtacgaaacgaactagtaggcgtgcaccactctcgtcttctactcttcccgtccctact

SEQ ID NO: 583952 - DNA, 485 bp, Homo sapiens; identical to SEQ ID NO: 536695
  misc_feature: HIJSMM301ETE2Y.10.1.A01.1.454.light.4.raw

SEQ ID NO: 583953 - DNA, 498 bp, Homo sapiens
  misc_feature: HIJSMM301BU8RT.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcaacctgcagcctgaagatcttgcaacatattactgtcaacagtataataatctcccgtacacttttggccagggaccaagctggagatcaaacgaactgtggctgcaccatctgtcttcatt

SEQ ID NO: 583954 - DNA, 497 bp, Homo sapiens; identical to SEQ ID NO: 536371
  misc_feature: HIJSMM301A3ZUC.16.78.H01.1.454.light.4.raw

SEQ ID NO: 583955 - DNA, 476 bp, Homo sapiens; identical to SEQ ID NO: 560169
  misc_feature: HIJSMM301DABX3.12.1.A01.1.454.light.4.raw

SEQ ID NO: 583956 - DNA, 502 bp, Homo sapiens
  misc_feature: HIJSMM301C53JQ.10.7.A07.1.454.light.4.raw
catagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattaggagctccttagcctggtaccaacagaaatatggccaggctcccaggctcctcatctatgaaacatccaatagggccactgccatcccttccaggttcagtggcagtgggtctgggacagacttcactctcatcatcagcggcctagagcctgaagattctgcagtttactactgtcagcaccgtaccgagtggcctccccaacccactttcggcggagggaccaaggtggagatcaaacgaactgtggctgcaccatctgtcttcatcttcccg

SEQ ID NO: 583957 - DNA, 527 bp, Homo sapiens
  misc_feature: HIJSMM301AQOF2.5.27.C05.1.454.light.4.raw
atcagacacgcacgaccggtgctcgatttagacgcgatcgaagggtttgggggtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaacccacctcgtcactctgttcccaccctccctcccgtcgttc

SEQ ID NO: 583958 - DNA, 502 bp, Homo sapiens
  misc_feature: HIJSMM301CD3U9.27.78.H01.1.454.light.4.raw
  modified_base (494)..(494): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgctttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttggccaagggcacgactgganattaaacg

SEQ ID NO: 583959 - DNA, 496 bp, Homo sapiens
  misc_feature: HIJSMM301EXJ1M.48.4.A04.1.454.light.4.raw
agtatacatacacgaccggtgctcgatttagagtagtgatcagggggagtcagtctcagtcaggacacagcatggacatgagggtccccgctcagctcctggggctcctgctactctggctccgaggtgccagatgtgacatccagatgacccagtctccatcatccctgtctgcatatgtgggggacagagtcaccatcacttgccgggcaagtcagagcattagtaggtatttaaattggtatcatcaaagaccagggatggcccctaacctcctgatctacggtacatccactttgcaaagtggggtcccctcaaggttcagcggcagtggctcttggacggatttcactctcaccatcaccagtcttcaggctgaagatttaggaatttactactgtcagcagacttacagtgttccgtacacttttggccaggggaccaaactggagatgaaacgaactgtggctgcaccatctgtcttctatcctccccg

SEQ ID NO: 583960 - DNA, 521 bp, Homo sapiens
  misc_feature: HIJSMM301EM56K.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaaggaccgaaggtaggcaatcaaaccgaaactgtggctgcaccatctgtcttcatctccccg

SEQ ID NO: 583961 - DNA, 476 bp, Homo sapiens
  misc_feature: HIJSMM301BUT0M.48.28.C06.1.454.light.4.raw
agtatacatacacgaccggtgctcgatttagagctcacgtattgggtttggggtggggagcctagctgtgctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaag

SEQ ID NO: 583962 - DNA, 513 bp, Homo sapiens
  misc_feature: HIJSMM301DH6DF.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcgggagggaccgaaaataagaggtacgaacgaaactagtggcgtgcaccactctgtcttctactt

SEQ ID NO: 583963 - DNA, 507 bp, Homo sapiens; identical to SEQ ID NO: 539817
  misc_feature: HIJSMM301AG3EH.5.24.C02.1.454.light.4.raw

SEQ ID NO: 583964 - DNA, 453 bp, Homo sapiens
  misc_feature: HIJSMM301A335G.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagtccaaggctgccccatcggtcactctgttccccgccctcctctagtacgtga

SEQ ID NO: 583965 - DNA, 521 bp, Homo sapiens
  misc_feature: HIJSMM301BQ84S.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttccccncct

SEQ ID NO: 583966 - DNA, 512 bp, Homo sapiens
  misc_feature: HIJSMM301BMIQR.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggaggaccaagctgaccgtcttaagtcagcccaaggctgccccctggtcactctcgttcccaccctcct

SEQ ID NO: 583967 - DNA, 506 bp, Homo sapiens; identical to SEQ ID NO: 543993
  misc_feature: HIJSMM301A09Q2.18.78.H01.1.454.light.4.raw

SEQ ID NO: 583968 - DNA, 523 bp, Homo sapiens
  misc_feature: HIJSMM301B2EHZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaactgctcattaactgggcatctacccggcaactccggggtccctcgaccgattcagtggcccccagcgggtcgtgggacagatttcactctcaccatcagcagcctgcaggctgaagatgtggctagtttattactgtcaactagttttctcgggcgtcggtccgaacgggaccgaaggtaggaaagtacaaacgaactaggtggtcgtgcaccactctgtcttctactcttccccg

SEQ ID NO: 583969 - DNA, 408 bp, Homo sapiens; identical to SEQ ID NO: 547850
  misc_feature: HIJSMM301ERVL1.43.24.C02.1.454.light.4.raw

SEQ ID NO: 583970 - DNA, 485 bp, Homo sapiens
  misc_feature: HIJSMM301BZCW5.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggagtat

SEQ ID NO: 583971 - DNA, 488 bp, Homo sapiens
  misc_feature: HIJSMM301DW55C.3.77.G11.1.454.light.4.raw
agacgcactccacgaccggtgctcgatttagctagtcactcaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtgagagacagcgtcaccatcacttgccgggcaagtcaaagcattagcacttatttgaattggtttcggcagaaaccggggacagcccctgagctcctgatctataaagcatccaatttgcaaactggggtcccatcaaggttcagtggcagtggatctgggacacatttcactctcaccatcagcaatctgcaacctgaagattttgcaacttactactgtcaacagagttttagtccccagtggacgttcggccaagggaccagggtggaaatcaaacgaactgtggctgcaccatctgt

SEQ ID NO: 583972 - DNA, 497 bp, Homo sapiens
  misc_feature: HIJSMM301BMHSA.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccgaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgctagtttattactgtcagcagtataatgtacttgggttttattctactttcggccgtgggaccaaagtggtattcagacgaactgtggctgcaccatctgtcttcta

SEQ ID NO: 583973 - DNA, 488 bp, Homo sapiens; identical to SEQ ID NO: 537673
  misc_feature: HIJSMM301ASCYF.12.31.C09.1.454.light.4.raw

SEQ ID NO: 583974 - DNA, 459 bp, Homo sapiens; identical to SEQ ID NO: 547319
  misc_feature: HIJSMM301DOI92.22.28.C06.1.454.light.4.raw

SEQ ID NO: 583975 - DNA, 487 bp, Homo sapiens
  misc_feature: HIJSMM301DZQO2.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgttatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtctaggtcagcccaaggccaaccca

SEQ ID NO: 583976 - DNA, 509 bp, Homo sapiens; identical to SEQ ID NO: 541829
  misc_feature: HIJSMM301D0EZ4.17.28.C06.1.454.light.4.raw

SEQ ID NO: 583977 - DNA, 456 bp, Homo sapiens
  misc_feature: HIJSMM301CD14V.52.23.C01.1.454.light.4.raw
  modified_base (446)..(446): a, c, t, g, unknown or other
cgcagtacgacacgaccggtgctcgatttagtacacgtgattagggattggggcagtcccaaccaggacacagcatggacatgagggtccctgctcagctcctggggctcctgctgctctggctctcaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacatttttacttcaccatcagcggcctgcagcctgagattttgcaacatattactgtcaacaatatgaagatctcccctcactttcggcggagggaccaaggtggagatcagaacgaactgtggctgcaccatctgtcttcatcttcccgcatctgntaatcgatcg

SEQ ID NO: 583978 - DNA, 493 bp, Homo sapiens; identical to SEQ ID NO: 539456
  misc_feature: HIJSMM301DSZ41.10.79.H02.1.454.light.4.raw

SEQ ID NO: 583979 - DNA, 518 bp, Homo sapiens; identical to SEQ ID NO: 535407
  misc_feature: HIJSMM301EC3NK.22.30.C08.1.454.light.4.raw

SEQ ID NO: 583980 - DNA, 505 bp, Homo sapiens
  misc_feature: HIJSMM301D80E3.15.5.A05.1.454.light.4.raw
tctacgtagccacgaccggtgctcgatttagatagatagacaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgacccttcgggtgcgcagcctgaggatgaggctgagtattactgcttgctctcctatagtggtgttcgggtgttcggcggagggaccaagctgaccgtcctaggtcagcccaaggctgccccctcggtcactctgttcccaccctcctcgctacgtaga

SEQ ID NO: 583981 - DNA, 485 bp, Homo sapiens; identical to SEQ ID NO: 538787
  misc_feature: HIJSMM301A030P.49.57.F02.1.454.light.4.raw

SEQ ID NO: 583982 - DNA, 493 bp, Homo sapiens; identical to SEQ ID NO: 539394
  misc_feature: HIJSMM301C0FH2.10.79.H02.1.454.light.4.raw

SEQ ID NO: 583983 - DNA, 509 bp, Homo sapiens
  misc_feature: HIJSMM301BPRJH.12.48.E04.1.454.light.4.raw
atacgacgtacacgaccggtgctcgatttagagagcgtcacagagagaaggggggggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctcggtcact

SEQ ID NO: 583984 - DNA, 521 bp, Homo sapiens
  misc_feature: HIJSMM301A506U.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 583985 - DNA, 484 bp, Homo sapiens
  misc_feature: HIJSMM301DJVKU.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagccaaggccaa

SEQ ID NO: 583986 - DNA, 517 bp, Homo sapiens
  misc_feature: HIJSMM301CFOCU.47.53.E09.1.454.light.4.raw
agctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaatttggtcatatgttgttcggcggagggaccaagctgaccgtcctcggtcagcccaaggctgccccctcggtcactctgttcccaccctt

SEQ ID NO: 583987 - DNA, 502 bp, Homo sapiens; identical to SEQ ID NO: 541345
  misc_feature: HIJSMM301CDE9V.21.22.B11.1.454.light.4.raw
  modified_base (429)..(429): a, c, t, g, unknown or other

SEQ ID NO: 583988 - DNA, 499 bp, Homo sapiens
  misc_feature: HIJSMM301DP7W9.9.71.G05.1.454.light.4.raw
tgatacgtctcacgaccggtgctcgatttagtgtcgtcgcaagagagaggggggggtcgacaagaggcagcgctctcgggacggtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccaccactcttaatttatgaggtcactaagcggccctcaggggtttctgtcgcttctctgcctccaagtctggcaacacggcctccctgacaatctctggctccagtctgacgacgaggctgattattactgcagctcatatgcagttggttcctctttctaagatattcggcggagggaccaggctgaccgtcctcgagtcagcccaaggctg

SEQ ID NO: 583989 - DNA, 511 bp, Homo sapiens
  misc_feature: HIJSMM301A0SE5.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcacggacgaacgaggagtacaacgaactagtggcgtgcaccactctgtcttctactcttccgtccactctcgat

SEQ ID NO: 583990 - DNA, 514 bp, Homo sapiens; identical to SEQ ID NO: 538153
  misc_feature: HIJSMM301BP34I.17.37.D04.1.454.light.4.raw

SEQ ID NO: 583991 - DNA, 474 bp, Homo sapiens
  misc_feature: HIJSMM301CDPMU.22.28.C06.1.454.light.4.raw
  modified_base (132)..(132): a, c, t, g, unknown or other
acatacgcgtcacgaccggtgctcgatttagagctcacgtattgggtttgggggccgtccctgggcccagtctgtgttgactcagccacccctcagcgtctgggaccccccgggcagaggggtcaccatctnttcccccccccgttctggaagcgactccaacatcggcgatactcatgtgtactggtaccaacaggtcccagggacggccccccaaactcctcatgtatgacagtagtgagcggccctcaggggtccctgaccgattctctggctctaagtctggcacctcggcctcccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccgccctcctcacgcgtatgt

SEQ ID NO: 583992 - DNA, 502 bp, Homo sapiens; identical to SEQ ID NO: 541501
  misc_feature: HIJSMM301AGI2G.17.27.C05.1.454.light.4.raw

SEQ ID NO: 583993 - DNA, 486 bp, Homo sapiens
  misc_feature: HIJSMM301EOQNN.16.68.G02.1.454.light.4.raw
  modified_base (263)..(263): a, c, t, g, unknown or other
  modified_base (483)..(483): a, c, t, g, unknown or other
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccngggaaagcccctaaggtcctgatatatgagacttctactttagaaagtgggtcccatcaaggttcagcggcagtggatctgggacagaattcactctcactatcaccagcctgcaacctgatgattttgcaacttattactgccaacagtatcatcatcattgtaatttcggtggagggaccaaggtgaggtcaaacgaactgtggctgcaccatctgtnttc

SEQ ID NO: 583994 - DNA, 494 bp, Homo sapiens; identical to SEQ ID NO: 559643
  misc_feature: HIJSMM301DPMK6.27.78.H01.1.454.light.4.raw

SEQ ID NO: 583995 - DNA, 506 bp, Homo sapiens
  misc_feature: HIJSMM301C3VL9.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggccaagctgaccgttcg

SEQ ID NO: 583996 - DNA, 472 bp, Homo sapiens; identical to SEQ ID NO: 536302
  misc_feature: HIJSMM301BRETM.18.76.G10.1.454.light.4.raw

SEQ ID NO: 583997 - DNA, 494 bp, Homo sapiens; identical to SEQ ID NO: 558688
  misc_feature: HIJSMM301ENBTL.47.78.H01.1.454.light.4.raw

SEQ ID NO: 583998 - DNA, 491 bp, Homo sapiens
  misc_feature: HIJSMM301CZTEY.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgagatttgcagtttattactgtcagcagtataataactggcctccgtacatgtacacttttggccaggggaccaacctggagatcagacgaa

SEQ ID NO: 583999 - DNA, 491 bp, Homo sapiens
  misc_feature: HIJSMM301AX2CE.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaagctgcagatgattggtccgtccagtttccaagatggggccccatcgagattccgcgtcagtggatctgggacagatttcactctcaccatcaccaacctgcaggctgaagatgtggcagtttattactgtcagcaatactatagtcctcctctcacgttcggcggagggaccaaggtggagatcaaacgaactgtggctgcaccatctgtcttcta

SEQ ID NO: 584000 - DNA, 478 bp, Homo sapiens
  misc_feature: HIJSMM301C5K5I.49.63.F08.1.454.light.4.raw
agtcgagagacacgaccggtgctcgatttagcgatcgtataaggggcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcggctatttaaattggtatctgcacagtccagggaaagcccctaaggtcctgatttatgctgcatccagtttgcaaagtggggtcccatcaaggttcattggcagtggatttgggacagatttcactctcaccatcaccagtctgcgacctgaggattttggaacatactactgtcaacacagttacagtataccgtacagttttggccaggggaccaagctggagatcacacgaactgtggctgcaccatctgtt

SEQ ID NO: 584001 - DNA, 510 bp, Homo sapiens
  misc_feature: HIJSMM301EA9KK.19.78.H01.1.454.light.4.raw
tactctcgtgcacgaccggtgctcgatttagtgtgagtagtttggggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctggggctccaggcgtgagggacgaggctgattactactgctgctcatatgcaggtcgtatctcttatgtcttcggaactgggaccaaggtcaccgtcctaggtcagcccaaggccaaccccactgtca

SEQ ID NO: 584002 - DNA, 472 bp, Homo sapiens
  misc_feature: HIJSMM301EOYRG.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagctaattttttagcctggtatcagcagaaccagggaagttccacacctcctgatctatgctgcatccgctttgcaatcaggggtcccatctcggttcagcggcagtggatctgggacagagttcactctcaccatcagcagcctgcagcctgagatgttgcaacttatactgtcaaaagtataacagtcgcccccttcaccttcggccaagggacacgactggagattagaacg

SEQ ID NO: 584003 - DNA, 521 bp, Homo sapiens
  misc_feature: HIJSMM301EBX5B.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctcgccccctcggtcactctgttcccaccct

SEQ ID NO: 584004 - DNA, 506 bp, Homo sapiens; identical to SEQ ID NO: 534969
  misc_feature: HIJSMM301BDDK6.18.37.D04.1.454.light.4.raw

SEQ ID NO: 584005 - DNA, 460 bp, Homo sapiens; identical to SEQ ID NO: 539553
  misc_feature: HIJSMM301CF6LG.11.86.H09.1.454.light.4.raw

SEQ ID NO: 584006 - DNA, 500 bp, Homo sapiens; identical to SEQ ID NO: 553383
  misc_feature: HIJSMM301BQ27G.18.11.A11.1.454.light.4.raw

SEQ ID NO: 584007 - DNA, 463 bp, Homo sapiens
  misc_feature: HIJSMM301DL5ZC.11.73.G07.1.454.light.4.raw
  modified_base (445)..(445): a, c, t, g, unknown or other
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccngagtggacatgaaacgaa

SEQ ID NO: 584008 - DNA, 496 bp, Homo sapiens
  misc_feature: HIJSMM301BZ0FE.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgt

SEQ ID NO: 584009 - DNA, 493 bp, Homo sapiens; identical to SEQ ID NO: 537281
  misc_feature: HIJSMM301BEOHR.9.1.A01.1.454.light.4.raw

SEQ ID NO: 584010 - DNA, 486 bp, Homo sapiens; identical to SEQ ID NO: 535043
  misc_feature: HIJSMM301CAN34.46.35.D02.1.454.light.4.raw

SEQ ID NO: 584011 - DNA, 466 bp, Homo sapiens
  misc_feature: HIJSMM301BSAHI.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggaggatcagacgaactgtggctgcaccatctgtcttcatcttcccgccatctgaagtatagtct

SEQ ID NO: 584012 - DNA, 474 bp, Homo sapiens
  misc_feature: HIJSMM301AYWJE.13.76.G10.1.454.light.4.raw
tcacgtactacacgaccggtgctcgatttagtcactcatacagggggcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactggaccaaggtcaccgtcctaagtcagccc

SEQ ID NO: 584013 - DNA, 517 bp, Homo sapiens; identical to SEQ ID NO: 552807
  misc_feature: HIJSMM301EPNP8.10.26.C04.1.454.light.4.raw

SEQ ID NO: 584014 - DNA, 511 bp, Homo sapiens
  misc_feature: HIJSMM301AOMUN.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccaacggtaggaaagtacaaacgaacctagtggtcgtgcaccatctgtcttcatcttccccg

SEQ ID NO: 584015 - DNA, 504 bp, Homo sapiens
  misc_feature: HIJSMM301BHXGY.48.23.C01.1.454.light.4.raw
agtatacatacacgaccggtgctcgatttagtacacgtgattagggattggggtcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccggtcagagtgtcaccatctcttgttctggaagcggctccaacatcggaagaaatactgtgaactggtaccagcagctcccaggagcggcccccagactctacatctataataattatcgccggccctcaggggtccctgaccgagtctctgcctccaagtctggcacctcagcctccctggccatcagtggcctccggtctgaagaggagggtgattattactgtgcagcgtgggatgacagcctgaatgcttgggtgttcggcggagggaccaagttgaccgtctaggtcaaccaaggctcg

SEQ ID NO: 584016 - DNA, 496 bp, Homo sapiens; identical to SEQ ID NO: 537925
  misc_feature: HIJSMM301EJWEV.22.14.B03.1.454.light.4.raw

SEQ ID NO: 584017 - DNA, 500 bp, Homo sapiens
  misc_feature: HIJSMM301A2PWM.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccgaaggtgaccgtccgtaggtcagcccaaggccg

SEQ ID NO: 584018 - DNA, 492 bp, Homo sapiens
  misc_feature: HIJSMM301ET9NA.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggtagggaccaaggtggaggtcaaacgaactagtggctgcaccatctgtcttcat

SEQ ID NO: 584019 - DNA, 496 bp, Homo sapiens
  misc_feature: HIJSMM301ELD7I.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaaggcgctcgttaggctggtatcagcagaaagcagggaaccccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttaccccctcacttttcggcggtagggaccgaaggtaggaggatcaagcgaactgtggctgcaccatctgtctt

SEQ ID NO: 584020 - DNA, 520 bp, Homo sapiens
  misc_feature: HIJSMM301BEJCJ.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgagggataaccctacggcccctctggggtcccctcctcgggtttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 584021 - DNA, 487 bp, Homo sapiens; identical to SEQ ID NO: 555619
  misc_feature: HIJSMM301BOX2I.46.35.D02.1.454.light.4.raw

SEQ ID NO: 584022 - DNA, 507 bp, Homo sapiens
  misc_feature: HIJSMM301C9THS.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcact

SEQ ID NO: 584023 - DNA, 493 bp, Homo sapiens; identical to SEQ ID NO: 540127
  misc_feature: HIJSMM301B1XJI.10.17.B06.1.454.light.4.raw

SEQ ID NO: 584024 - DNA, 457 bp, Homo sapiens; identical to SEQ ID NO: 554231
  misc_feature: HIJSMM301BSL2D.18.78.H01.1.454.light.4.raw

SEQ ID NO: 584025 - DNA, 484 bp, Homo sapiens; identical to SEQ ID NO: 535400
  misc_feature: HIJSMM301CRY69.46.26.C04.1.454.light.4.raw

SEQ ID NO: 584026 - DNA, 504 bp, Homo sapiens; identical to SEQ ID NO: 539083
  misc_feature: HIJSMM301A50Q8.8.19.B08.1.454.light.4.raw

SEQ ID NO: 584027 - DNA, 505 bp, Homo sapiens
  misc_feature: HIJSMM301DQ35L.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtcacgggacgacacgtagaaatagagacgaactagtggctgcaccatctgtcttctactcttcccgt

SEQ ID NO: 584028 - DNA, 504 bp, Homo sapiens; identical to SEQ ID NO: 550151
  misc_feature: HIJSMM301BY1DS.2.21.B10.1.454.light.4.raw

SEQ ID NO: 584029 - DNA, 508 bp, Homo sapiens
  misc_feature: HIJSMM301APQR5.51.27.C05.1.454.light.4.raw
cgatcgtatacacgaccggtgctcgatttagacgcgatcgaagggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcact

SEQ ID NO: 584030 - DNA, 511 bp, Homo sapiens
  misc_feature: HIJSMM301ALFCV.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcgtccaacgggaccgaaggtcggaaagtcaaacgaactacgtggcgtgcaccatctgtcttctatcttccccg

SEQ ID NO: 584031 - DNA, 489 bp, Homo sapiens; identical to SEQ ID NO: 548339
  misc_feature: HIJSMM301AT3O5.16.86.H09.1.454.light.4.raw

SEQ ID NO: 584032 - DNA, 487 bp, Homo sapiens; identical to SEQ ID NO: 536206
  misc_feature: HIJSMM301D3S8K.47.38.D05.1.454.light.4.raw

SEQ ID NO: 584033 - DNA, 485 bp, Homo sapiens; identical to SEQ ID NO: 539299
  misc_feature: HIJSMM301EZ956.3.10.A10.1.454.light.4.raw

SEQ ID NO: 584034 - DNA, 503 bp, Homo sapiens
  misc_feature: HIJSMM301BC2X2.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttcacctccaggacacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtca

SEQ ID NO: 584035 - DNA, 501 bp, Homo sapiens; identical to SEQ ID NO: 550122
  misc_feature: HIJSMM301EESE7.51.19.B08.1.454.light.4.raw

SEQ ID NO: 584036 - DNA, 518 bp, Homo sapiens
  misc_feature: HIJSMM301B681H.48.27.C05.1.454.light.4.raw
agtatacatacacgaccggtgctcgatttagacgcgatcgaagggtttggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgtattttcggcggtagggaccaaactgaccgtctggtcagcccaaggctgccccctcggtcactctgttcccaccctcctct

SEQ ID NO: 584037 - DNA, 499 bp, Homo sapiens
  misc_feature: HIJSMM301EEAYB.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctcgggacccccgggcagagggtcaccatttcttgttctggaacccactccaacatcggatataattctgtagactggtaccagcagcttccaggagcggccccccgactcctcatctttaataacaatcagcggccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaaggctgaccgtctaggtcagcccaa

SEQ ID NO: 584038 - DNA, 482 bp, Homo sapiens; identical to SEQ ID NO: 558052
  misc_feature: HIJSMM301CIU23.49.81.H04.1.454.light.4.raw

SEQ ID NO: 584039 - DNA, 481 bp, Homo sapiens; identical to SEQ ID NO: 539712
  misc_feature: HIJSMM301CLL2C.51.60.F05.1.454.light.4.raw

SEQ ID NO: 584040 - DNA, 495 bp, Homo sapiens
  misc_feature: HIJSMM301EGFJX.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggctccctgaccgtctctgggctccagcctgaggatgaggctgattattactgcagctcatatgcaggcatcaacactgttttcggcggagggaccaagctgaccgtcctaggtcagcccaaggctgccccc

SEQ ID NO: 584041 - DNA, 471 bp, Homo sapiens
  misc_feature: HIJSMM301EANCU.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagatttaatttcaccatcagcagcctccaacgtgatgatgttgcaacatactattgtcagcaatatgattttgctcctccgagtgccacttttggcgggggaccaaggtggacgatcaaacgaa

SEQ ID NO: 584042 - DNA, 466 bp, Homo sapiens; identical to SEQ ID NO: 536398
  misc_feature: HIJSMM301AWRQL.3.20.B09.1.454.light.4.raw

SEQ ID NO: 584043 - DNA, 487 bp, Homo sapiens; identical to SEQ ID NO: 555619
  misc_feature: HIJSMM301AY8NO.46.35.D02.1.454.light.4.raw

SEQ ID NO: 584044 - DNA, 447 bp, Homo sapiens; identical to SEQ ID NO: 535020
  misc_feature: HIJSMM301AEPHH.18.9.A09.1.454.light.4.raw

SEQ ID NO: 584045 - DNA, 493 bp, Homo sapiens
  misc_feature: HIJSMM301EO2HL.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccgagggtggagatcagacgaactgtggctgcaccatctgtt

SEQ ID NO: 584046 - DNA, 487 bp, Homo sapiens; identical to SEQ ID NO: 539157
  misc_feature: HIJSMM301EYR9W.26.37.D04.1.454.light.4.raw

SEQ ID NO: 584047 - DNA, 495 bp, Homo sapiens
  misc_feature: HIJSMM301ERX5F.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctgccccctcggtcactctgttcccaccctcctcgagtgcgtct

SEQ ID NO: 584048 - DNA, 476 bp, Homo sapiens
  misc_feature: HIJSMM301D21YA.51.68.G02.1.454.light.4.raw
cgatcgtatacacgaccggtgctcgatttagtcgatagtgaagggaaaggggagtcccaaccaggacacagcatgaacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacaggggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaactgtggctgcacc

SEQ ID NO: 584049 - DNA, 494 bp, Homo sapiens; identical to SEQ ID NO: 539894
  misc_feature: HIJSMM301D2JTW.16.53.E09.1.454.light.4.raw

SEQ ID NO: 584050 - DNA, 504 bp, Homo sapiens; identical to SEQ ID NO: 538940
  misc_feature: HIJSMM301COQEO.2.35.D02.1.454.light.4.raw

SEQ ID NO: 584051 - DNA, 497 bp, Homo sapiens
  misc_feature: HIJSMM301AK8ZX.22.57.F02.1.454.light.4.raw
acatacgcgtcacgaccggtgctcgatttagctcgatatagttgggtttgggaggctggtctcactttgtgcaggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaaggacacgactggagattaaacgaactagtggc

SEQ ID NO: 584052 - DNA, 516 bp, Homo sapiens; identical to SEQ ID NO: 535549
  misc_feature: HIJSMM301AUSSN.14.70.G04.1.454.light.4.raw

SEQ ID NO: 584053 - DNA, 514 bp, Homo sapiens; identical to SEQ ID NO: 541418
  misc_feature: HIJSMM301APID7.17.33.C11.1.454.light.4.raw

SEQ ID NO: 584054 - DNA, 493 bp, Homo sapiens
  misc_feature: HIJSMM301COXXY.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctactactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagattttgaagtttatttctgtctgcagtacaatcagtggcctcggacgtgtccgaggaccgaaggtaggaagtacaaacgaacagtggctgcaccaactctcgtcttctat

SEQ ID NO: 584055 - DNA, 534 bp, Homo sapiens
  misc_feature: HIJSMM301EAFDL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtggttcggcggaggggaccgagggctcggacccgttcccgtaggtcagcccaaggctcgccccctcggtcacctctcgttcccaccct

SEQ ID NO: 584056 - DNA, 483 bp, Homo sapiens; identical to SEQ ID NO: 538138
  misc_feature: HIJSMM301BSLOD.41.34.D01.1.454.light.4.raw

SEQ ID NO: 584057 - DNA, 504 bp, Homo sapiens; identical to SEQ ID NO: 538521
  misc_feature: HIJSMM301B4RB0.9.12.B01.1.454.light.4.raw

SEQ ID NO: 584058 - DNA, 492 bp, Homo sapiens
  misc_feature: HIJSMM301C67YC.13.39.D06.1.454.light.4.raw
tcacgtactacacgaccggtgctcgatttagtgacatctcgcagttctttggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaagaac

SEQ ID NO: 584059 - DNA, 485 bp, Homo sapiens; identical to SEQ ID NO: 536723
  misc_feature: HIJSMM301CT6VV.5.40.D07.1.454.light.4.raw

SEQ ID NO: 584060 - DNA, 484 bp, Homo sapiens; identical to SEQ ID NO: 535400
  misc_feature: HIJSMM301BBBAH.46.26.C04.1.454.light.4.raw

SEQ ID NO: 584061 - DNA, 497 bp, Homo sapiens; identical to SEQ ID NO: 534982
  misc_feature: HIJSMM301BF3OU.26.80.H03.1.454.light.4.raw

SEQ ID NO: 584062 - DNA, 485 bp, Homo sapiens
  misc_feature: HIJSMM301EAL7J.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttactactgccaacagtcttacggaacctcgtacacttttggccaggggaccaggctggagatcaaaacgaactgtggctgcaccatcctgtt

SEQ ID NO: 584063 - DNA, 501 bp, Homo sapiens
  misc_feature: HIJSMM301ADRKW.5.24.C02.1.454.light.4.raw
atcagacacgcacgaccggtgctcgatttagtacagatcgttagggaaagggggctggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccgaagctgaccgtcctaggtcagcccaagg

SEQ ID NO: 584064 - DNA, 512 bp, Homo sapiens; identical to SEQ ID NO: 575333
  misc_feature: HIJSMM301A20TF.48.17.B06.1.454.light.4.raw

SEQ ID NO: 584065 - DNA, 473 bp, Homo sapiens; identical to SEQ ID NO: 541215
  misc_feature: HIJSMM301CPCYQ.13.48.E04.1.454.light.4.raw

SEQ ID NO: 584066 - DNA, 454 bp, Homo sapiens; identical to SEQ ID NO: 536846
  misc_feature: HIJSMM301DE753.18.78.H01.1.454.light.4.raw

SEQ ID NO: 584067 - DNA, 485 bp, Homo sapiens; identical to SEQ ID NO: 536040
  misc_feature: HIJSMM301DB2OM.15.1.A01.1.454.light.4.raw

SEQ ID NO: 584068 - DNA, 383 bp, Homo sapiens
  misc_feature: HIJSMM301AMUOQ.41.38.D05.1.454.light.4.raw
tctatactatcacgaccggtgctcgatttagtatctgatagttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 584069 - DNA, 506 bp, Homo sapiens
  misc_feature: HIJSMM301DFDYN.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctcgtccccccg

SEQ ID NO: 584070 - DNA, 510 bp, Homo sapiens
  misc_feature: HIJSMM301D3U2E.8.28.C06.1.454.light.4.raw
  modified_base (480)..(480): a, c, t, g, unknown or other
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgtactttgctagttttatttctgtcagcagtctgaagactggccgttcactttcgggcggagggaccaaggtggacctacaaacgaactgnggctgcaccatctgtcttcatccttcccgc

SEQ ID NO: 584071 - DNA, 487 bp, Homo sapiens
  misc_feature: HIJSMM301CEWA5.52.71.G05.1.454.light.4.raw
cgcagtacgacacgaccggtgctcgatttagtgtcgtcgcaagagagaggggggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttggacaaagctgccctaacatcacggggcccaggcagatgatgaatctgattattactgtgtcctctatatgggtagtggcatttggatgttcggcggagggacc

SEQ ID NO: 584072 - DNA, 504 bp, Homo sapiens
  misc_feature: HIJSMM301ASGY1.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccacgcactctctatgtcttcggaactgggaccaaggtcaccgtcctaggtcagcccaaggccaccccact

SEQ ID NO: 584073 - DNA, 511 bp, Homo sapiens
  misc_feature: HIJSMM301BUH73.43.23.C01.1.454.light.4.raw
tgtgagtagtcacgaccggtgctcgatttagtacacgtgattagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtggcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcact

SEQ ID NO: 584074 - DNA, 479 bp, Homo sapiens
  misc_feature: HIJSMM301EQYM8.26.72.G06.1.454.light.4.raw
  modified_base (473)..(473): a, c, t, g, unknown or other
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagtcgtttttgtgtttgagatgttagctcaggtcaattccaaagagtaccagattctttcaaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatgaagttaacactgtggatcaccttcggccaagggacacgactggagattaaacgaactgtggctgcaccatctgtcttcatcttcccgccatctgaagtntagtct

SEQ ID NO: 584075 - DNA, 504 bp, Homo sapiens
  misc_feature: HIJSMM301BM9OD.40.33.C11.1.454.light.4.raw
tctagcgactcacgaccggtgctcgatttagagtgagctcgttgggtttgggggggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtcctaggtcagcccaaggctgccccctc

SEQ ID NO: 584076 - DNA, 497 bp, Homo sapiens; identical to SEQ ID NO: 536807
  misc_feature: HIJSMM301B21EN.10.37.D04.1.454.light.4.raw

SEQ ID NO: 584077 - DNA, 495 bp, Homo sapiens; identical to SEQ ID NO: 535007
  misc_feature: HIJSMM301C7WR0.22.5.A05.1.454.light.4.raw

SEQ ID NO: 584078 - DNA, 494 bp, Homo sapiens; identical to SEQ ID NO: 536221
  misc_feature: HIJSMM301AZNUU.15.59.F04.1.454.light.4.raw

SEQ ID NO: 584079 - DNA, 484 bp, Homo sapiens; identical to SEQ ID NO: 535400
  misc_feature: HIJSMM301CIGL5.46.26.C04.1.454.light.4.raw

SEQ ID NO: 584080 - DNA, 520 bp, Homo sapiens
  misc_feature: HIJSMM301EZJT3.10.86.H09.1.454.light.4.raw
catagtagtgcacgaccggtgctcgatttagtgctatagacttgggtttggggagctctgcttcagctgtgagcgcagaaggcgggactcgggacaatcttcatcatgacctgctcccctctcctcctctcccttctcattcactgcacagggtcctgggcccagtctttgttgacgcagccgccctcagtgtctgcggccccaggacagagggtcaccgtctcctgctctggaagcgcctccaacattggcacgaattatgtatcctggtaccagcacttccccgggacagcccccaaactcctcatctatgaagattttacgcgaccctcagggattcctggccgattctctggctccaagtcaggcacctctgccaccctggacatcaccgggctccagaccggggacgaggccgattattactgcgcaacttgggactccaacctgactgttggggctttcggcggagggactaagttgaccgtcctacgtcagcccaagctgccccctcggtcta

SEQ ID NO: 584081 - DNA, 508 bp, Homo sapiens; identical to SEQ ID NO: 552440
  misc_feature: HIJSMM301DW64P.5.24.C02.1.454.light.4.raw

SEQ ID NO: 584082 - DNA, 473 bp, Homo sapiens; identical to SEQ ID NO: 546369
  misc_feature: HIJSMM301AMH3P.18.76.G10.1.454.light.4.raw

SEQ ID NO: 584083 - DNA, 495 bp, Homo sapiens; identical to SEQ ID NO: 535486
  misc_feature: HIJSMM301COBC9.26.72.G06.1.454.light.4.raw

SEQ ID NO: 584084 - DNA, 498 bp, Homo sapiens
  misc_feature: HIJSMM301A7BT7.9.81.H04.1.454.light.4.raw
tgatacgtctcacgaccggtgctcgatttagtagtgtagattcgcggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccaggtcaccgtcctaggtcagcccaaggccaaccccactgtcact

SEQ ID NO: 584085 - DNA, 383 bp, Homo sapiens; identical to SEQ ID NO: 553009
  misc_feature: HIJSMM301D6IO2.41.25.C03.1.454.light.4.raw

SEQ ID NO: 584086 - DNA, 509 bp, Homo sapiens; identical to SEQ ID NO: 535670
  misc_feature: HIJSMM301BTRNC.47.23.C01.1.454.light.4.raw

SEQ ID NO: 584087 - DNA, 504 bp, Homo sapiens; identical to SEQ ID NO: 537776
  misc_feature: HIJSMM301AYCJP.8.71.G05.1.454.light.4.raw

SEQ ID NO: 584088 - DNA, 485 bp, Homo sapiens
  misc_feature: HIJSMM301BTHCU.26.60.F05.1.454.light.4.raw
agactatactcacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgtctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggccaagggacacggactggagattaaacgaactgtggctgcaccat

SEQ ID NO: 584089 - DNA, 481 bp, Homo sapiens; identical to SEQ ID NO: 539249
  misc_feature: HIJSMM301CI03T.11.76.G10.1.454.light.4.raw

SEQ ID NO: 584090 - DNA, 465 bp, Homo sapiens; identical to SEQ ID NO: 561271
  misc_feature: HIJSMM301BR1E3.13.4.A04.1.454.light.4.raw

SEQ ID NO: 584091 - DNA, 497 bp, Homo sapiens
  misc_feature: HIJSMM301D2Z78.9.39.D06.1.454.light.4.raw
  modified_base (200)..(200): a, c, t, g, unknown or other
tgatacgtctcacgaccggtgctcgatttagtgacatctcgcagttctttgggggaggaactgctcagttaggacccagacggaaccatggaagccccagcgcagcttctcttcctcctgctactctgggtcccagataccactggagaaatagtgatgacgcagtctccagccaccctggctgtgtctccaggggaaanagccaccctctcctgcagggccagtcagagtgttagtagtaggttagcctggcaccagcaaaaacctggccagcctcccaggctcctcatctatgatgcatccaccaggaccactggtgtcccagccaggttcagtgggagtgggtctgggacagagttcactctcaccatcagcagtctgcagtcggaagattttgcagtttactattgtcagcagtatagtaacgggccgctcactttcggcggagggaccaaggtggagatcaaacgaactgtggctgcaccatctgtcttcta

SEQ ID NO: 584092 - DNA, 481 bp, Homo sapiens; identical to SEQ ID NO: 535993
  misc_feature: HIJSMM301ANDU2.21.25.C03.1.454.light.4.raw

SEQ ID NO: 584093 - DNA, 488 bp, Homo sapiens
  misc_feature: HIJSMM301A9L14.51.71.G05.1.454.light.4.raw
cgatcgtatacacgaccggtgctcgatttagtgtcgtcgcaagagagagggggtggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggt

SEQ ID NO: 584094 - DNA, 509 bp, Homo sapiens; identical to SEQ ID NO: 539359
  misc_feature: HIJSMM301A96DS.47.85.H08.1.454.light.4.raw

SEQ ID NO: 584095 - DNA, 506 bp, Homo sapiens; identical to SEQ ID NO: 535058
  misc_feature: HIJSMM301AYZNF.17.41.D08.1.454.light.4.raw

SEQ ID NO: 584096 - DNA, 496 bp, Homo sapiens; identical to SEQ ID NO: 552950
  misc_feature: HIJSMM301ANN74.3.71.G05.1.454.light.4.raw

SEQ ID NO: 584097 - DNA, 537 bp, Homo sapiens
  misc_feature: HIJSMM301A6LKI.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaaggtacgtaaacgaaactacgtaggtcgtgcgaccactactcgtcttcctacttaccttcccgtccctactcctcgt

SEQ ID NO: 584098 - DNA, 501 bp, Homo sapiens
  misc_feature: HIJSMM301AUBOU.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggaggaccaaactgaccgtcctaggtcagcccaaggctgccccctc

SEQ ID NO: 584099 - DNA, 514 bp, Homo sapiens
  misc_feature: HIJSMM301A6JSK.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcagagggaccatgctgaccgtcctgagtcagcccaaggctgccccctcggtcactctgttcccta

SEQ ID NO: 584100 - DNA, 487 bp, Homo sapiens
  misc_feature: HIJSMM301DR5BL.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctcctgaccatcactggactcaagcctgaggacgaggctgactattactgttcagcatgggacggcagcctcagtgaatgggtgttcggcggagggaccaaactgtccgtcctaggtcaggacccc

SEQ ID NO: 584101 - DNA, 495 bp, Homo sapiens
  misc_feature: HIJSMM301BM99S.11.71.G05.1.454.light.4.raw
cgagagataccacgaccggtgctcgatttagtgtcgtcgcaagagagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgctagtttattactgtcagcagcgtatcgactggatcaccttcggccaagggacacgactggaaattaaacgaactgtggctgcaccatctgtcttcatt

SEQ ID NO: 584102 - DNA, 505 bp, Homo sapiens; identical to SEQ ID NO: 547532
  misc_feature: HIJSMM301AOUOM.8.1.A01.1.454.light.4.raw

SEQ ID NO: 584103 - DNA, 501 bp, Homo sapiens; identical to SEQ ID NO: 569143
  misc_feature: HIJSMM301CHKMB.18.59.F04.1.454.light.4.raw

SEQ ID NO: 584104 - DNA, 513 bp, Homo sapiens; identical to SEQ ID NO: 543858
  misc_feature: HIJSMM301BCXZQ.17.37.D04.1.454.light.4.raw

SEQ ID NO: 584105 - DNA, 494 bp, Homo sapiens
  misc_feature: HIJSMM301AH7GH.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccaagtggaggatcaaacgaactgtggctgcaccatctgtctt

SEQ ID NO: 584106 - DNA, 489 bp, Homo sapiens
  misc_feature: HIJSMM301DPH2H.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggtaccagcagaagccaggccaggcccctctcttgattatatataaggacactgagaggccctcagggatccctgagcgattctctggctccagctcagggacaacactcaccttgaccatcagtgcagtccaggcaagaagacgaggctgactattattgtcaatcagcagtcagcactaattcttatcgggtgttcggcggagggaccaagctgaccgtcctac

SEQ ID NO: 584107 - DNA, 488 bp, Homo sapiens; identical to SEQ ID NO: 579007
  misc_feature: HIJSMM301A3JD1.26.23.C01.1.454.light.4.raw

SEQ ID NO: 584108 - DNA, 496 bp, Homo sapiens; identical to SEQ ID NO: 536326
  misc_feature: HIJSMM301ANHZN.16.12.B01.1.454.light.4.raw

SEQ ID NO: 584109 - DNA, 507 bp, Homo sapiens
  misc_feature: HIJSMM301B4TUQ.18.59.F04.1.454.light.4.raw
tacgagtatgcacgaccggtgctcgatttagtacacacacttagggattgggggggggtctcagggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactcg

SEQ ID NO: 584110 - DNA, 492 bp, Homo sapiens
  misc_feature: HIJSMM301DI68M.51.42.D09.1.454.light.4.raw
cgatcgtatacacgaccggtgctcgatttagacacatacgcaggggaaagggggaggaactgctcagtcaggacccagacggaaccatggaagccccagcgcagcttctcttcctcctgctactctggctcccagatactactggagaaatagtgatgacgcagtctccagccacgctgtctgtgtctccaggggaaagagccaccctctcctgcagggccagtcagagtgttaacaacaacttagcctggtatcagcagaaacctggccaggctcccaggctcctcatctttggatcatccatcagggccactggtgtcccagaaaagttcagtggcggtgggtctgacacagagtacaccctcaccatcagcaccctgcagtctgaagatgtcgcagtttattactgtcaacaatatagtgacaggccgccatggacgttcggccaagggaccaaggtggaaatgaaaaggaactgtggctgcaccatct

SEQ ID NO: 584111 - DNA, 501 bp, Homo sapiens; identical to SEQ ID NO: 535509
  misc_feature: HIJSMM301BOB6M.15.56.F01.1.454.light.4.raw

SEQ ID NO: 584112 - DNA, 504 bp, Homo sapiens; identical to SEQ ID NO: 538423
  misc_feature: HIJSMM301A7K4C.48.67.G01.1.454.light.4.raw

SEQ ID NO: 584113 - DNA, 481 bp, Homo sapiens
  misc_feature: HIJSMM301BRHXD.49.28.C06.1.454.light.4.raw
agtcgagagacacgaccggtgctcgatttagagctcacgtattgggtttggggaggaactgctcagttaggacccagacggaaccatggaagccccagcgcagcttctcttcctcctgctactctggctcccagagaccactggagaaatagcgatgacgcagtctccagccaccctgtctgtgtctccaggggaaagagccaccctctcctgcagggccagtcagagtgttagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataattactggctcgttttggccaggggaccaagctggagatcaagcgaactgtggctgcaccat

SEQ ID NO: 584114 - DNA, 478 bp, Homo sapiens; identical to SEQ ID NO: 535129
  misc_feature: HIJSMM301AQAB7.11.11.A11.1.454.light.4.raw

SEQ ID NO: 584115 - DNA, 498 bp, Homo sapiens
  misc_feature: HIJSMM301D28H8.21.27.C05.1.454.light.4.raw
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccgaaggtggaaatacaaacgaactagtggctgcaccatctgtctt

SEQ ID NO: 584116 - DNA, 487 bp, Homo sapiens
  misc_feature: HIJSMM301B1TKD.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttcggccaagggaccaaggtggataattcagacgaa

SEQ ID NO: 584117 - DNA, 471 bp, Homo sapiens; identical to SEQ ID NO: 537461
  misc_feature: HIJSMM301C27AT.7.81.H04.1.454.light.4.raw

SEQ ID NO: 584118 - DNA, 467 bp, Homo sapiens
  misc_feature: HIJSMM301DVPFN.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaatacaaacgaa

SEQ ID NO: 584119 - DNA, 516 bp, Homo sapiens
  misc_feature: HIJSMM301CWUC2.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagatttacactgaaaatcagcagagtggaggctgaggatgttggggtttattactgcatgcaagctctacaaaattcctcggacgttcggtccaacgggaccgaacggtagggaaagtacgaaacgaaacctagttaggcgttggcacccaatccttcg

SEQ ID NO: 584120 - DNA, 490 bp, Homo sapiens
  misc_feature: HIJSMM301EMPGQ.8.53.E09.1.454.light.4.raw
ctcgcgtgtccacgaccggtgctcgatttagagagagtgtgttgggtttgggggcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcagggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacg

SEQ ID NO: 584121 - DNA, 500 bp, Homo sapiens
  misc_feature: HIJSMM301CJNOZ.19.57.F02.1.454.light.4.raw
tactctcgtgcacgaccggtgctcgatttagctcgatatagttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcgaaggttcagcggcagtggatctgggacagatttcactctcgccatcagcagcctgcagactgaagattttgcaactttatttttgtcaacaggctaacacctttccccctctactttcggtcggagggaccgaaggtggagatcaagcgaactgtggctgcaccactcttcg

SEQ ID NO: 584122 - DNA, 485 bp, Homo sapiens; identical to SEQ ID NO: 536576
  misc_feature: HIJSMM301C6DT2.46.35.D02.1.454.light.4.raw

SEQ ID NO: 584123 - DNA, 505 bp, Homo sapiens; identical to SEQ ID NO: 535503
  misc_feature: HIJSMM301A6BGI.8.28.C06.1.454.light.4.raw

SEQ ID NO: 584124 - DNA, 489 bp, Homo sapiens
  misc_feature: HIJSMM301DOH5Y.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgacccattacctggactccagcctgaggacgaggctgactattactgctcagcatgggacagcagcctcaatgtttgggtgttcggcggagggaccaagctgaccgccctaggtcacg

SEQ ID NO: 584125 - DNA, 508 bp, Homo sapiens
  misc_feature: HIJSMM301B5TMK.11.86.H09.1.454.light.4.raw
cgagagataccacgaccggtgctcgatttagtgctatagacttgggtttggggcagcttcagctgtgggtagagaagacaggactcaggacaatctccagcatggccagcttccctctcctcctcaccctcctcactcactgtgcagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctcg

SEQ ID NO: 584126 - DNA, 515 bp, Homo sapiens
  misc_feature: HIJSMM301CK91M.49.11.A11.1.454.light.4.raw
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaagaccaaccccactgtcactctgttcccgccctcctctctctcg

SEQ ID NO: 584127 - DNA, 500 bp, Homo sapiens
  misc_feature: HIJSMM301CXA1F.12.86.H09.1.454.light.4.raw
atacgacgtacacgaccggtgctcgatttagtgctatagacttgggtttggggagggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtgggtctggggcagacttcactctcaccatcagcagcctagagcctgaagattttgcagtttattactgtcagcagcgtagcaactggcctcggttcacttttggccaggggaccaagctggagatcaaacgaactgtggctgcaccatctgtcttcatt

SEQ ID NO: 584128 - DNA, 447 bp, Homo sapiens; identical to SEQ ID NO: 535201
  misc_feature: HIJSMM301AP4KO.18.9.A09.1.454.light.4.raw

SEQ ID NO: 584129 - DNA, 492 bp, Homo sapiens
  misc_feature: HIJSMM301AGV6Z.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgccacggggacgatcgtgatgacccacgtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaa

SEQ ID NO: 584130 - DNA, 514 bp, Homo sapiens
  misc_feature: HIJSMM301DWEY0.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtgtgttcggcggagggaccaagctggccgtcctaggtcagcccaagggctgccccctggtcactctgttccccgccctcctcgagtagtaca

SEQ ID NO: 584131 - DNA, 484 bp, Homo sapiens; identical to SEQ ID NO: 535240
  misc_feature: HIJSMM301DNUPL.47.60.F05.1.454.light.4.raw

SEQ ID NO: 584132 - DNA, 481 bp, Homo sapiens
  misc_feature: HIJSMM301EFLK2.5.7.A07.1.454.light.4.raw
atcagacacgcacgaccggtgctcgatttagcacgtgtcgcagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagaccgagtcaccatcacttgccgggcaagtcagaacattaccacctatttacattggtatctgcagaagccagggagagcccctaagctcctgatctatgcttcatccaatttgcacagtggggtcccgtcaaggttcagtggcggtggctctgagacagatttcactctcaccatcagcagtctgcaacctgaagattttgcaacttactactgtcaacagagttaccggtacccccctcactttcggcggagggaccaaggttgagatctaacgaactgtggctgcaccc

SEQ ID NO: 584133 - DNA, 488 bp, Homo sapiens
  misc_feature: HIJSMM301DGXDP.48.70.G04.1.454.light.4.raw
agtatacatacacgaccggtgctcgatttagtgtagtgtgaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 584134 - DNA, 496 bp, Homo sapiens; identical to SEQ ID NO: 535660
  misc_feature: HIJSMM301ESRB7.43.25.C03.1.454.light.4.raw

SEQ ID NO: 584135 - DNA, 483 bp, Homo sapiens; identical to SEQ ID NO: 555750
  misc_feature: HIJSMM301ETGRN.41.78.H01.1.454.light.4.raw

SEQ ID NO: 584136 - DNA, 484 bp, Homo sapiens; identical to SEQ ID NO: 535400
  misc_feature: HIJSMM301CPW92.46.26.C04.1.454.light.4.raw

SEQ ID NO: 584137 - DNA, 482 bp, Homo sapiens
  misc_feature: HIJSMM301CJ97S.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcacttcgtcggacgggacgacgggtaggaggagt

SEQ ID NO: 584138 - DNA, 486 bp, Homo sapiens; identical to SEQ ID NO: 535917
  misc_feature: HIJSMM301CFUO2.3.10.A10.1.454.light.4.raw

SEQ ID NO: 584139 - DNA, 456 bp, Homo sapiens
  misc_feature: HIJSMM301BAFPG.19.86.H09.1.454.light.4.raw
  modified_base (426)..(426): a, c, t, g, unknown or other
tactctcgtgcacgaccggtgctcgatttagtgctatagacttgggtttgggggccgttcctgggcccagtatgtgctgactcaggcaccctcagcgtctgggacccccgggaagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcgcaaggctcgccccctcggtcnctctcgttcccaccctcctccacgagagta

SEQ ID NO: 584140 - DNA, 517 bp, Homo sapiens
  misc_feature: HIJSMM301EEY72.22.30.C08.1.454.light.4.raw
acatacgcgtcacgaccggtgctcgatttagtctgacgtcaaagggaaaggggagagctctggggatctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacg

SEQ ID NO: 584141 - DNA, 503 bp, Homo sapiens; identical to SEQ ID NO: 540136
  misc_feature: HIJSMM301CRKS8.19.10.A10.1.454.light.4.raw

SEQ ID NO: 584142 - DNA, 484 bp, Homo sapiens; identical to SEQ ID NO: 535240
  misc_feature: HIJSMM301BZ1FD.47.60.F05.1.454.light.4.raw

SEQ ID NO: 584143 - DNA, 479 bp, Homo sapiens
  misc_feature: HIJSMM301DU2YU.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcagggtcccatcaaggttcagtggaagtggatctgggacagattttactttcaccatcaccagcctgcagcctgaagatattgcaacatattactgtcaacagtatgataatctccctccactttcggcgagggaccaaggtggagatacaaacgaactgtggctgcacc

SEQ ID NO: 584144 - DNA, 521 bp, Homo sapiens; identical to SEQ ID NO: 538715
  misc_feature: HIJSMM301EJEKS.27.23.C01.1.454.light.4.raw

SEQ ID NO: 584145 - DNA, 491 bp, Homo sapiens; identical to SEQ ID NO: 535194
  misc_feature: HIJSMM301EI3GV.26.78.H01.1.454.light.4.raw

SEQ ID NO: 584146 - DNA, 504 bp, Homo sapiens
  misc_feature: HIJSMM301DA4MY.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtcccggcacctcagcctccctggccatcagtgggctccgggccgaggatgaggctgatttattactgtgcaggatgggatgacaacctgggtgcttatctctcggacctgggaccaaggtcaccgtccttggt

SEQ ID NO: 584147 - DNA, 496 bp, Homo sapiens
  misc_feature: HIJSMM301BZDW5.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcgggacgttcggccaagggaccgaaacgtaggacgatcaagcgaactgtggctgcaccatctgtt

SEQ ID NO: 584148 - DNA, 490 bp, Homo sapiens
  misc_feature: HIJSMM301EVDBH.49.38.D05.1.454.light.4.raw
agtcgagagacacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgt

SEQ ID NO: 584149 - DNA, 489 bp, Homo sapiens; identical to SEQ ID NO: 549527
  misc_feature: HIJSMM301A50NL.15.49.E05.1.454.light.4.raw

SEQ ID NO: 584150 - DNA, 507 bp, Homo sapiens; identical to SEQ ID NO: 572598
  misc_feature: HIJSMM301BQ5BB.5.60.F05.1.454.light.4.raw

SEQ ID NO: 584151 - DNA, 491 bp, Homo sapiens
  misc_feature: HIJSMM301ALKLW.17.1.A01.1.454.light.4.raw
cgtagactagcacgaccggtgctcgatttagacgtctcatcaggagtcagacccactcaggacacagcatggacatcagggtccccgctcagctcctggggctcctgctgctctggctcccaggtgccagatgtgccatccaaatgacccagtctccatcctccctgtctgcatctgtaggagacagagttaccatcacttgccgggcaagtcagggcattagaaatgatttaggctggtatcaacaaaaactagggagagcccctaaactcctgatctatgctgcatccagtttgtagactggggtcccatcaaggttcagcggcagtggatctggcacagatttcactctcaccatcagcagcctgcagcctgaagattttgcaacttattactgtctacaagattacgattaccctcggacgttcggtccaacgggaccgaacggtaggagaagtctaaacgaacctagtggcgtgcaccactctgtt

SEQ ID NO: 584152 - DNA, 518 bp, Homo sapiens; identical to SEQ ID NO: 539372
  misc_feature: HIJSMM301CG2UA.7.86.H09.1.454.light.4.raw

SEQ ID NO: 584153 - DNA, 502 bp, Homo sapiens
  misc_feature: HIJSMM301BPZVB.10.65.F10.1.454.light.4.raw
catagtagtgcacgaccggtgctcgatttagctacgctctaagggggcaggagtcagtctcagtcaggacacagcatggacatgagggtccccgctcagctcctggggctcctgctactctggctccgaggtgccagatgtgacatccagatgacccagtctccaccgtccctgtctgcatttgttggagacagagtcaccatctcttgccggacaagtcagaacattgacacctatttgaattggtatcaacaaaaactggggaaagcccctacactcctgatcaatgcagcgtccagtttacagagtggggtcccctcaaggttcagtggcagtggatctgggacagactttactctcaccatcagcgatctgcagcctgacgattttgcgacttactactgtcaacagagtttccggaaccccgttactttcggtcggagggaccgaaggtggagatcaaacgaactagtggctgcaccatctgtcttcatcttccccg

SEQ ID NO: 584154 - DNA, 510 bp, Homo sapiens
  misc_feature: HIJSMM301DAQRK.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccccctgaccggttctctggctccaagtctggctcttccgcctccttggccatcactgggctcgaggctgacgatgaggctgattactactgtctgtcctatgacgacgacctacagactccggttttcggcggagggactaagctgaccgtcctaagtcagcccaaggctgccccctcggtccactcctgttcccg

SEQ ID NO: 584155 - DNA, 501 bp, Homo sapiens; identical to SEQ ID NO: 536142
  misc_feature: HIJSMM301D6JSW.15.1.A01.1.454.light.4.raw

SEQ ID NO: 584156 - DNA, 447 bp, Homo sapiens; identical to SEQ ID NO: 535020
  misc_feature: HIJSMM301B2UXV.18.9.A09.1.454.light.4.raw

SEQ ID NO: 584157 - DNA, 508 bp, Homo sapiens
  misc_feature: HIJSMM301EKVL7.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcgggcgttcggtccaagggaccgaaggtaggaaagtcaaacgaactagtggctgcaccatctgtcttcatcttccccg

SEQ ID NO: 584158 - DNA, 495 bp, Homo sapiens; identical to SEQ ID NO: 546624
  misc_feature: HIJSMM301CORPV.52.38.D05.1.454.light.4.raw

SEQ ID NO: 584159 - DNA, 486 bp, Homo sapiens; identical to SEQ ID NO: 535043
  misc_feature: HIJSMM301EPBJN.46.35.D02.1.454.light.4.raw

SEQ ID NO: 584160 - DNA, 526 bp, Homo sapiens
  misc_feature: HIJSMM301CI8U2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgttcggccgaacgggaccgaacggtaggaaggtacgaaacgaaacgtagtggtcgtgcgaccactctcgtcttctactccttcccgtccctact

SEQ ID NO: 584161 - DNA, 489 bp, Homo sapiens
  misc_feature: HIJSMM301D8NTB.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggccaggggaccaagctggagatcacaggaactgtggctgcaccatt

SEQ ID NO: 584162 - DNA, 520 bp, Homo sapiens; identical to SEQ ID NO: 563649
  misc_feature: HIJSMM301EHDLN.27.23.C01.1.454.light.4.raw

SEQ ID NO: 584163 - DNA, 484 bp, Homo sapiens; identical to SEQ ID NO: 535400
  misc_feature: HIJSMM301AGAZT.46.26.C04.1.454.light.4.raw

SEQ ID NO: 584164 - DNA, 522 bp, Homo sapiens; identical to SEQ ID NO: 563052
  misc_feature: HIJSMM301BRXF5.27.23.C01.1.454.light.4.raw

SEQ ID NO: 584165 - DNA, 509 bp, Homo sapiens
  misc_feature: HIJSMM301EYSQG.5.58.F03.1.454.light.4.raw
atcagacacgcacgaccggtgctcgatttagtctgatcgagaagggaaagggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgaccaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaacccactgtcactctgtt

SEQ ID NO: 584166 - DNA, 506 bp, Homo sapiens
  misc_feature: HIJSMM301E3RND.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaactcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcacggacgaacggaggaagtacaagacgaactagtggcgtcgcgaccactactcgtcttctatt

SEQ ID NO: 584167 - DNA, 506 bp, Homo sapiens
  misc_feature: HIJSMM301EJ098.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtccgtgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccccatgtca

SEQ ID NO: 584168 - DNA, 507 bp, Homo sapiens; identical to SEQ ID NO: 538063
  misc_feature: HIJSMM301CIZN5.47.85.H08.1.454.light.4.raw

SEQ ID NO: 584169 - DNA, 441 bp, Homo sapiens; identical to SEQ ID NO: 546257
  misc_feature: HIJSMM301D4NR9.41.9.A09.1.454.light.4.raw

SEQ ID NO: 584170 - DNA, 496 bp, Homo sapiens; identical to SEQ ID NO: 535541
  misc_feature: HIJSMM301DUVCM.3.33.C11.1.454.light.4.raw

SEQ ID NO: 584171 - DNA, 484 bp, Homo sapiens; identical to SEQ ID NO: 535400
  misc_feature: HIJSMM301ARZ1W.46.26.C04.1.454.light.4.raw

SEQ ID NO: 584172 - DNA, 504 bp, Homo sapiens; identical to SEQ ID NO: 538521
  misc_feature: HIJSMM301C2IE8.9.12.B01.1.454.light.4.raw

SEQ ID NO: 584173 - DNA, 495 bp, Homo sapiens
  misc_feature: HIJSMM301EAID0.5.23.C01.1.454.light.4.raw
atcagacacgcacgaccggtgctcgatttagtacacgtgattagggagttgggggagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttccggcggtagggaccaaggtggaggagtcaaacgaactgtggctgcaccatctgtctt

SEQ ID NO: 584174 - DNA, 521 bp, Homo sapiens; identical to SEQ ID NO: 538715
  misc_feature: HIJSMM301BB2EQ.27.23.C01.1.454.light.4.raw

SEQ ID NO: 584175 - DNA, 510 bp, Homo sapiens
  misc_feature: HIJSMM301BXTBM.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattccccaggatccggccccccgactcctcatctatagaaatgatcatcggccctccggggtccctgaccgattctctggctccatgtctggcacctcagcctccctgaccatcagtgggctccggtccgaggatgaggctgattattactgtgcaccgtggatgacatcctgaatggtccggtgttcggcggagggccaggctgaccgtcctaagtcagcccaaggctgccccccg

SEQ ID NO: 584176 - DNA, 521 bp, Homo sapiens
  misc_feature: HIJSMM301DNUVG.16.88.H11.1.454.light.4.raw
tgtactactccacgaccggtgctcgatttagcgacagcgagaacacacaaaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactcctgttcccgccctcctcgt

SEQ ID NO: 584177 - DNA, 493 bp, Homo sapiens; identical to SEQ ID NO: 535770
  misc_feature: HIJSMM301D0CWU.51.71.G05.1.454.light.4.raw

SEQ ID NO: 584178 - DNA, 448 bp, Homo sapiens; identical to SEQ ID NO: 540364
  misc_feature: HIJSMM301AH0S8.18.9.A09.1.454.light.4.raw

SEQ ID NO: 584179 - DNA, 488 bp, Homo sapiens; identical to SEQ ID NO: 538017
  misc_feature: HIJSMM301AV1R3.4.59.F04.1.454.light.4.raw

SEQ ID NO: 584180 - DNA, 485 bp, Homo sapiens; identical to SEQ ID NO: 535688
  misc_feature: HIJSMM301BK2UZ.19.5.A05.1.454.light.4.raw

SEQ ID NO: 584181 - DNA, 492 bp, Homo sapiens
  misc_feature: HIJSMM301DNZXC.51.6.A06.1.454.light.4.raw
cgatcgtatacacgaccggtgctcgatttagatctactgacagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgattctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcagcccaaggccaaccccactgtcactctcg

SEQ ID NO: 584182 - DNA, 494 bp, Homo sapiens; identical to SEQ ID NO: 539922
  misc_feature: HIJSMM301DWRXA.27.78.H01.1.454.light.4.raw

SEQ ID NO: 584183 - DNA, 509 bp, Homo sapiens; identical to SEQ ID NO: 535670
  misc_feature: HIJSMM301ATGMM.47.23.C01.1.454.light.4.raw

SEQ ID NO: 584184 - DNA, 501 bp, Homo sapiens; identical to SEQ ID NO: 535746
  misc_feature: HIJSMM301CN8LU.18.11.A11.1.454.light.4.raw

SEQ ID NO: 584185 - DNA, 477 bp, Homo sapiens
  misc_feature: HIJSMM301DYA52.5.52.E08.1.454.light.4.raw
atcagacacgcacgaccggtgctcgatttagtcgagctctcagagagaaaggggctgatcaggactcctcagttcaccttctcacaatgaggctccctgctcagctcctggggctgctaatgctctgggtctctggatccagtggggagattgtgctgactcagtctccactctccctgcccgtcacccctggagagccggcctccatctcctgcaggtctagtcagagcctcctgcatagtaatggattcaactatttggattggtacctgcagaggccagggcagtctccacagctcctgatctatttgggctcttatcgggcctccggggtccctgagaggttcagtggcagtggatcaggcacagactttacactgagaatcagcagagtggaggctgaggatgttgggggtttattactgcatgcaagctctacaaaccctattcactttcggccctggaccagagtggata

SEQ ID NO: 584186 - DNA, 505 bp, Homo sapiens; identical to SEQ ID NO: 551816
  misc_feature: HIJSMM301BXELL.18.78.H01.1.454.light.4.raw

SEQ ID NO: 584187 - DNA, 503 bp, Homo sapiens
  misc_feature: HIJSMM301DHRQZ.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcccaaccccactgtca

SEQ ID NO: 584188 - DNA, 503 bp, Homo sapiens
  misc_feature: HIJSMM301DL7PQ.15.1.A01.1.454.light.4.raw
  modified_base (488)..(488): a, c, t, g, unknown or other
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctcgttcccaccctctcgctacgagatagnggcggcgtggacgac

SEQ ID NO: 584189 - DNA, 454 bp, Homo sapiens; identical to SEQ ID NO: 535005
  misc_feature: HIJSMM301ED9BZ.19.86.H09.1.454.light.4.raw

SEQ ID NO: 584190 - DNA, 495 bp, Homo sapiens; identical to SEQ ID NO: 535486
  misc_feature: HIJSMM301B48KX.26.72.G06.1.454.light.4.raw

SEQ ID NO: 584191 - DNA, 502 bp, Homo sapiens; identical to SEQ ID NO: 537298
  misc_feature: HIJSMM301BF4W4.27.78.H01.1.454.light.4.raw

SEQ ID NO: 584192 - DNA, 508 bp, Homo sapiens; identical to SEQ ID NO: 536388
  misc_feature: HIJSMM301D6VSR.11.57.F02.1.454.light.4.raw

SEQ ID NO: 584193 - DNA, 483 bp, Homo sapiens
  misc_feature: HIJSMM301B6839.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagatttacactgaaaatcagcagagtggaggctgaggatgttgggctctattattgcatgcaagctctacaagtcccgctcactttcggcggagggaccaaggtggagatcaaacgaa

SEQ ID NO: 584194 - DNA, 507 bp, Homo sapiens
  misc_feature: HIJSMM301A5XWZ.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattatactgcagctcatattcaggcagcaacagggtattcggcggagggaccaagttgaccgtcctaggtcagcccaaggctgccccctcggtcactctgttcccaccct

SEQ ID NO: 584195 - DNA, 407 bp, Homo sapiens; identical to SEQ ID NO: 536776
  misc_feature: HIJSMM301BOSD7.40.8.A08.1.454.light.4.raw

SEQ ID NO: 584196 - DNA, 496 bp, Homo sapiens
  misc_feature: HIJSMM301CQ46E.52.53.E09.1.454.light.4.raw
cgcagtacgacacgaccggtgctcgatttagagagagtgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 584197 - DNA, 505 bp, Homo sapiens; identical to SEQ ID NO: 539033
  misc_feature: HIJSMM301D41A5.22.21.B10.1.454.light.4.raw

SEQ ID NO: 584198 - DNA, 499 bp, Homo sapiens
  misc_feature: HIJSMM301BZSB7.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctccttcagacgttcggccaagggaccaaggtaggaaatcaaacgaactgtggctgcacc

SEQ ID NO: 584199 - DNA, 502 bp, Homo sapiens
  misc_feature: HIJSMM301C8WDC.51.23.C01.1.454.light.4.raw
cgatcgtatacacgaccggtgctcgatttagtacacgtgattagggattggggggaactgctcagttaggacccagagggaaccatggaagccccagctcagcttctcttcctcctgctactctggctcccagataccatcggggaaactgtgttgacacagtctccagccaccctgtctttgtctccaggggaaagagccaccctctcctgcagggccagtgagagtattgacatcttcttggcctggtaccaacagaaacctggccaggctccccgactcctcatttatgatgcatccaaaagggtcgttggcatcccagccaggttcagtggcagtgggtctgggacagaattcactctcaccatcaccagactagagcctgaagattttgcagtttattactgtcagcagcgtaacaactggctctctttcggcggagggaccaaggtggagatcaaacgaactgtggctgcaccatctgtcttcatcttcccgccat

SEQ ID NO: 584200 - DNA, 508 bp, Homo sapiens
  misc_feature: HIJSMM301BBFAV.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggtcggagggaccgaaaataagaggtcaaacgaactagtggctgcaccatctgtcttctatt

SEQ ID NO: 584201 - DNA, 490 bp, Homo sapiens; identical to SEQ ID NO: 536481
  misc_feature: HIJSMM301EZ48A.13.46.E02.1.454.light.4.raw

SEQ ID NO: 584202 - DNA, 492 bp, Homo sapiens
  misc_feature: HIJSMM301A9SOA.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccagggaccgaaggtaggaaatacaaacgaactagtggctgcaccta

SEQ ID NO: 584203 - DNA, 502 bp, Homo sapiens
  misc_feature: HIJSMM301BIGON.51.83.H06.1.454.light.4.raw
cgatcgtatacacgaccggtgctcgatttagatcacgtgcgtcgcggggctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgt

SEQ ID NO: 584204 - DNA, 493 bp, Homo sapiens; identical to SEQ ID NO: 558967
  misc_feature: HIJSMM301DRD8C.11.59.F04.1.454.light.4.raw

SEQ ID NO: 584205 - DNA, 459 bp, Homo sapiens
  misc_feature: HIJSMM301APTS6.10.86.H09.1.454.light.4.raw
catagtagtgcacgaccggtgctcgatttagtgctatagacttgggtttgggggctgtcccggggaagtgctggtaccaggatacataattcgccctcagtgtctgcggccccaggacagagggtcaccgtctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggccaaccccactgtcactctgttcccaccctcctccactactatg

SEQ ID NO: 584206 - DNA, 506 bp, Homo sapiens
  misc_feature: HIJSMM301DRIX3.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataattctgggtgttcggcggagggaccaaactgaccgtcctaggtcagcccaaggcctgccccctcggtccactctcgtt

SEQ ID NO: 584207 - DNA, 487 bp, Homo sapiens
  misc_feature: HIJSMM301BFC8J.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggtccaagggaccaaggtaggaaagtacaaacgaaactagtggcgtgcacca

SEQ ID NO: 584208 - DNA, 500 bp, Homo sapiens
  misc_feature: HIJSMM301DRIJ3.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctcggtccgaggatgaggctgattattactgtgttggatgggacagcagcctgagtgcttatgtcttcggaactgggaccacggtcaccgtcctaggt

SEQ ID NO: 584209 - DNA, 507 bp, Homo sapiens; identical to SEQ ID NO: 568626
  misc_feature: HIJSMM301DGH44.19.78.H01.1.454.light.4.raw

SEQ ID NO: 584210 - DNA, 507 bp, Homo sapiens; identical to SEQ ID NO: 536226
  misc_feature: HIJSMM301C7VYH.18.37.D04.1.454.light.4.raw

SEQ ID NO: 584211 - DNA, 490 bp, Homo sapiens; identical to SEQ ID NO: 535234
  misc_feature: HIJSMM301AHOI9.17.21.B10.1.454.light.4.raw

SEQ ID NO: 584212 - DNA, 483 bp, Homo sapiens; identical to SEQ ID NO: 541990
  misc_feature: HIJSMM301DNXHI.46.26.C04.1.454.light.4.raw

SEQ ID NO: 584213 - DNA, 484 bp, Homo sapiens
  misc_feature: HIJSMM301CVJZ5.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccccctcctcgctacgtaga

SEQ ID NO: 584214 - DNA, 509 bp, Homo sapiens; identical to SEQ ID NO: 553073
  misc_feature: HIJSMM301C0YFU.16.1.A01.1.454.light.4.raw

SEQ ID NO: 584215 - DNA, 520 bp, Homo sapiens; identical to SEQ ID NO: 555124
  misc_feature: HIJSMM301CV189.27.23.C01.1.454.light.4.raw

SEQ ID NO: 584216 - DNA, 473 bp, Homo sapiens; identical to SEQ ID NO: 541472
  misc_feature: HIJSMM301EW66W.5.12.B01.1.454.light.4.raw

SEQ ID NO: 584217 - DNA, 482 bp, Homo sapiens
  misc_feature: HIJSMM301C6IYB.13.87.H10.1.454.light.4.raw
tcacgtactacacgaccggtgctcgatttagcagtactgcgttgggtttggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagagaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtgctgcaccat

SEQ ID NO: 584218 - DNA, 487 bp, Homo sapiens
  misc_feature: HIJSMM301ED6GN.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgctaatttattactgtcagcagtataataactggtggacgttcgggccaagggaccaaggtagaaatcaaacgaactgtggctgcaccatct

SEQ ID NO: 584219 - DNA, 506 bp, Homo sapiens; identical to SEQ ID NO: 563474
  misc_feature: HIJSMM301BEPFF.10.27.C05.1.454.light.4.raw

SEQ ID NO: 584220 - DNA, 478 bp, Homo sapiens; identical to SEQ ID NO: 573111
  misc_feature: HIJSMM301CVTMO.13.76.G10.1.454.light.4.raw

SEQ ID NO: 584221 - DNA, 509 bp, Homo sapiens; identical to SEQ ID NO: 536348
  misc_feature: HIJSMM301DR7A6.43.67.G01.1.454.light.4.raw

SEQ ID NO: 584222 - DNA, 486 bp, Homo sapiens; identical to SEQ ID NO: 535917
  misc_feature: HIJSMM301D9KUW.3.10.A10.1.454.light.4.raw

SEQ ID NO: 584223 - DNA, 495 bp, Homo sapiens
  misc_feature: HIJSMM301AI8AZ.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaactagtggtcg

SEQ ID NO: 584224 - DNA, 490 bp, Homo sapiens
  misc_feature: HIJSMM301EO6YM.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttatcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttatactgtcagcactattatagtaccccattcacattcggccctgggaccaaagtggagatcaaacgaactgtgg

SEQ ID NO: 584225 - DNA, 493 bp, Homo sapiens; identical to SEQ ID NO: 537281
  misc_feature: HIJSMM301AH8XA.9.1.A01.1.454.light.4.raw

SEQ ID NO: 584226 - DNA, 488 bp, Homo sapiens; identical to SEQ ID NO: 535081
  misc_feature: HIJSMM301DNGDY.26.23.C01.1.454.light.4.raw

SEQ ID NO: 584227 - DNA, 489 bp, Homo sapiens
  misc_feature: HIJSMM301ATO2L.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatcatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaaactgtggctgcaccatct

SEQ ID NO: 584228 - DNA, 486 bp, Homo sapiens; identical to SEQ ID NO: 545000
  misc_feature: HIJSMM301ER1VN.49.53.E09.1.454.light.4.raw

SEQ ID NO: 584229 - DNA, 502 bp, Homo sapiens
  misc_feature: HIJSMM301CLFR6.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtcac

SEQ ID NO: 584230 - DNA, 491 bp, Homo sapiens
  misc_feature: HIJSMM301CEZJ1.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagtatcatgactggccgctcaccttcggccaagggacacgactggagattaaacgaactgtggctgcaccatctgtt

SEQ ID NO: 584231 - DNA, 488 bp, Homo sapiens; identical to SEQ ID NO: 537673
  misc_feature: HIJSMM301BCYVO.12.31.C09.1.454.light.4.raw

SEQ ID NO: 584232 - DNA, 483 bp, Homo sapiens
  misc_feature: HIJSMM301BAF2I.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaattactattgtcaacaggctaacagtttccctttaatcttcggccaagggacacgactggagattaaacgaactgtggctgcacc

SEQ ID NO: 584233 - DNA, 508 bp, Homo sapiens
  misc_feature: HIJSMM301AIZDG.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaacaaccggccctcagggatcccagaccgattctctggctcctactcaggaaacacagcttccttgaccatcactggggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 584234 - DNA, 491 bp, Homo sapiens; identical to SEQ ID NO: 540256
  misc_feature: HIJSMM301A3I8Y.46.67.G01.1.454.light.4.raw

SEQ ID NO: 584235 - DNA, 484 bp, Homo sapiens; identical to SEQ ID NO: 535240
  misc_feature: HIJSMM301CSFGS.47.60.F05.1.454.light.4.raw

SEQ ID NO: 584236 - DNA, 502 bp, Homo sapiens; identical to SEQ ID NO: 558187
  misc_feature: HIJSMM301DHX0O.9.53.E09.1.454.light.4.raw

SEQ ID NO: 584237 - DNA, 511 bp, Homo sapiens
  misc_feature: HIJSMM301E2QG3.48.56.F01.1.454.light.4.raw
  modified_base (480)..(480): a, c, t, g, unknown or other
  modified_base (508)..(508): a, c, t, g, unknown or other
agtatacatacacgaccggtgctcgatttagcagacgtctgaacacacaaagggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttaancggtcagcccaaggctgccccctcggtnact

SEQ ID NO: 584238 - DNA, 468 bp, Homo sapiens
  misc_feature: HIJSMM301BC7LL.49.73.G07.1.454.light.4.raw
agtcgagagacacgaccggtgctcgatttagctctacgctcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcaacaaaaaccagggaaagcccctgagctcctgatcctcgatgcatccaatttggaaacaggggtcccatcgaggttctctggaagtggctctgggacacattttactttcaccatcagcagactgcagcctgaagatattgcaacatattactgtcaacagtatgataatctcccgctcactttcggcggagggaccaaggtggagatcaaacgaactgtgg

SEQ ID NO: 584239 - DNA, 494 bp, Homo sapiens; identical to SEQ ID NO: 542264
  misc_feature: HIJSMM301D2LRX.13.6.A06.1.454.light.4.raw

SEQ ID NO: 584240 - DNA, 521 bp, Homo sapiens
  misc_feature: HIJSMM301D0UJO.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttcccaccct

SEQ ID NO: 584241 - DNA, 507 bp, Homo sapiens
  misc_feature: HIJSMM301EQHNR.8.21.B10.1.454.light.4.raw
ctcgcgtgtccacgaccggtgctcgatttagtgtcgtcgcaaggagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactagtggctgcacatctgtcttcatcttcccgccatt

SEQ ID NO: 584242 - DNA, 519 bp, Homo sapiens
  misc_feature: HIJSMM301DRCTM.43.29.C07.1.454.light.4.raw
tgtgagtagtcacgaccggtgctcgatttagagtgctacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgtttgggggttatttacttgtcgatgcgaagactcctacctaaacctaccccaccggacgggacgggacggaacggtaggaggatacaaacgaaacctagtggcgtcgcgaccact

SEQ ID NO: 584243 - DNA, 470 bp, Homo sapiens
  misc_feature: HIJSMM301EV4ZR.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctctccgagtgccacttttggcggggggaccaaggtggacatcaaacgaa

SEQ ID NO: 584244 - DNA, 507 bp, Homo sapiens; identical to SEQ ID NO: 558669
  misc_feature: HIJSMM301ESREH.21.22.B11.1.454.light.4.raw

SEQ ID NO: 584245 - DNA, 447 bp, Homo sapiens; identical to SEQ ID NO: 535020
  misc_feature: HIJSMM301AYJCA.18.9.A09.1.454.light.4.raw

SEQ ID NO: 584246 - DNA, 503 bp, Homo sapiens
  misc_feature: HIJSMM301CACOH.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagccaaggctgccccctcggtcactctgtt

SEQ ID NO: 584247 - DNA, 482 bp, Homo sapiens
  misc_feature: HIJSMM301DRZWO.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacaagtaataacttaatctttatgtcttcggtatctggacaagggtcaccgtcctaggtcagcccaa

SEQ ID NO: 584248 - DNA, 475 bp, Homo sapiens; identical to SEQ ID NO: 536205
  misc_feature: HIJSMM301CB848.48.49.E05.1.454.light.4.raw

SEQ ID NO: 584249 - DNA, 495 bp, Homo sapiens; identical to SEQ ID NO: 538651
  misc_feature: HIJSMM301A8AQ1.10.79.H02.1.454.light.4.raw

SEQ ID NO: 584250 - DNA, 494 bp, Homo sapiens; identical to SEQ ID NO: 559643
  misc_feature: HIJSMM301ECU1G.27.78.H01.1.454.light.4.raw

SEQ ID NO: 584251 - DNA, 506 bp, Homo sapiens
  misc_feature: HIJSMM301AXEMI.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgaccgtctgggtcagcccaaggctgccccctcggtcactctgttccca

SEQ ID NO: 584252 - DNA, 494 bp, Homo sapiens; identical to SEQ ID NO: 534994
  misc_feature: HIJSMM301BGTQD.27.78.H01.1.454.light.4.raw

SEQ ID NO: 584253 - DNA, 498 bp, Homo sapiens
  misc_feature: HIJSMM301BIG37.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaaggctgaccgtcctaggtcagcccaaggctcgg

SEQ ID NO: 584254 - DNA, 510 bp, Homo sapiens
  misc_feature: HIJSMM301BEHFL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggctagtttattactgtcaactagttttctcggggcgttcggccgaagggaccgaaggtaggaaatacaaacgaactagtggctgcaccatctgtcttcatcttccccg

SEQ ID NO: 584255 - DNA, 454 bp, Homo sapiens
  misc_feature: HIJSMM301CKAKZ.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaccatctgtcttcatcttccgccatctgacacgagagta

SEQ ID NO: 584256 - DNA, 484 bp, Homo sapiens; identical to SEQ ID NO: 535400
  misc_feature: HIJSMM301A7P9Z.46.26.C04.1.454.light.4.raw

SEQ ID NO: 584257 - DNA, 482 bp, Homo sapiens
  misc_feature: HIJSMM301DKH70.48.19.B08.1.454.light.4.raw
  modified_base (422)..(422): a, c, t, g, unknown or other
  modified_base (445)..(445): a, c, t, g, unknown or other
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctcctgaccatctctgggctccaggctgaggatgaggctggattattactgctgctcatntgcaggcagctacacttggggtnttcggcggagggaccaagctagccgtcctaggtcacg

SEQ ID NO: 584258 - DNA, 505 bp, Homo sapiens; identical to SEQ ID NO: 537268
  misc_feature: HIJSMM301BIHC7.7.71.G05.1.454.light.4.raw

SEQ ID NO: 584259 - DNA, 494 bp, Homo sapiens; identical to SEQ ID NO: 534994
  misc_feature: HIJSMM301A72C3.27.78.H01.1.454.light.4.raw

SEQ ID NO: 584260 - DNA, 491 bp, Homo sapiens; identical to SEQ ID NO: 536211
  misc_feature: HIJSMM301EA5ST.16.53.E09.1.454.light.4.raw

SEQ ID NO: 584261 - DNA, 509 bp, Homo sapiens
  misc_feature: HIJSMM301C5RD3.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtctaagtcagcccaaggctgccccccg

SEQ ID NO: 584262 - DNA, 495 bp, Homo sapiens
  misc_feature: HIJSMM301CX7XT.41.59.F04.1.454.light.4.raw
  modified_base (476)..(476): a, c, t, g, unknown or other
  modified_base (479)..(479): a, c, t, g, unknown or other
tctatactatcacgaccggtgctcgatttagtacacacacttagggattgggggagtcagacccagtcaggacacaacatggacatgagggtccccgctcagctcctggggctcctgctgctctggttcccaggttcccgatgcggcatccagatgacccagtctccatctttcgtgtctgcatctataggagacagagtcaccatcacttgtcgggcgagtcaggatattaggacgtggttagcctggtatcgacagagaccgggaagagcccctgaactcctcgtctatgatgcatccactttacatcgtggggtcccatcacggttcagcggcagtggatctgggacagacttcagtctcaccatcagtaccctgcagcctgacgattttgcaatttatttttgtctaacaggctataggttcctcaaacattcggccctgggaccagagtggatttgaagtcgaactgtggntgnaccatctgtcttcatt

SEQ ID NO: 584263 - DNA, 494 bp, Homo sapiens
  misc_feature: HIJSMM301CZRAH.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcaccgtctaggtcagcccaatcgccaa

SEQ ID NO: 584264 - DNA, 508 bp, Homo sapiens; identical to SEQ ID NO: 536388
  misc_feature: HIJSMM301BOOP1.11.57.F02.1.454.light.4.raw

SEQ ID NO: 584265 - DNA, 495 bp, Homo sapiens; identical to SEQ ID NO: 559417
  misc_feature: HIJSMM301D3FOW.26.12.B01.1.454.light.4.raw

SEQ ID NO: 584266 - DNA, 497 bp, Homo sapiens
  misc_feature: HIJSMM301AOEQH.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgcccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 584267 - DNA, 499 bp, Homo sapiens; identical to SEQ ID NO: 538774
  misc_feature: HIJSMM301BFB46.26.26.C04.1.454.light.4.raw

SEQ ID NO: 584268 - DNA, 480 bp, Homo sapiens
  misc_feature: HIJSMM301CKAQY.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattactgtcagcagtattgtgaagctccgctcactttcggcggagggaccgcggtggagatcagacgaactgtggctgcaccatctgtctt

SEQ ID NO: 584269 - DNA, 494 bp, Homo sapiens; identical to SEQ ID NO: 534994
  misc_feature: HIJSMM301C7X8Y.27.78.H01.1.454.light.4.raw

SEQ ID NO: 584270 - DNA, 504 bp, Homo sapiens
  misc_feature: HIJSMM301C9DH6.16.46.E02.1.454.light.4.raw
tgtactactccacgaccggtgctcgatttagactcatctacagggaaaggggggagtctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggccaaggtcaccgtcctaggtcagcccaaggccacccactgtcact

SEQ ID NO: 584271 - DNA, 501 bp, Homo sapiens
  misc_feature: HIJSMM301CXQW0.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgctagtttattattgtcagcagtataataactggcctccgtggacgttcggccaagggaccaaggtggaaatcaaacgaactagtggctgcaccatctgtcttcta

SEQ ID NO: 584272 - DNA, 494 bp, Homo sapiens
  misc_feature: HIJSMM301DUEDY.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaagatggagttcaaacgaactgtggctgcaccatctgtcttcta

SEQ ID NO: 584273 - DNA, 497 bp, Homo sapiens
  misc_feature: HIJSMM301BZS2A.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcacc

SEQ ID NO: 584274 - DNA, 487 bp, Homo sapiens; identical to SEQ ID NO: 541889
  misc_feature: HIJSMM301CL4HR.26.23.C01.1.454.light.4.raw

SEQ ID NO: 584275 - DNA, 497 bp, Homo sapiens; identical to SEQ ID NO: 535664
  misc_feature: HIJSMM301AMIBV.22.14.B03.1.454.light.4.raw

SEQ ID NO: 584276 - DNA, 496 bp, Homo sapiens
  misc_feature: HIJSMM301A4BYK.15.25.C03.1.454.light.4.raw
tctacgtagccacgaccggtgctcgatttagtagtgtagatttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaccccgatcaccttcggccgagggacacgcctggagattaaacgaactgtggctgcacc

SEQ ID NO: 584277 - DNA, 476 bp, Homo sapiens; identical to SEQ ID NO: 538611
  misc_feature: HIJSMM301CWU4Y.7.81.H04.1.454.light.4.raw

SEQ ID NO: 584278 - DNA, 506 bp, Homo sapiens; identical to SEQ ID NO: 535058
  misc_feature: HIJSMM301E1RQ3.17.41.D08.1.454.light.4.raw

SEQ ID NO: 584279 - DNA, 494 bp, Homo sapiens; identical to SEQ ID NO: 534994
  misc_feature: HIJSMM301D8CFX.27.78.H01.1.454.light.4.raw

SEQ ID NO: 584280 - DNA, 494 bp, Homo sapiens; identical to SEQ ID NO: 534994
  misc_feature: HIJSMM301A66G4.27.78.H01.1.454.light.4.raw

SEQ ID NO: 584281 - DNA, 489 bp, Homo sapiens; identical to SEQ ID NO: 554439
  misc_feature: HIJSMM301A5FUI.14.55.E11.1.454.light.4.raw
  modified_base (427)..(427): a, c, t, g, unknown or other

SEQ ID NO: 584282 - DNA, 517 bp, Homo sapiens; identical to SEQ ID NO: 536262
  misc_feature: HIJSMM301EZSEI.14.70.G04.1.454.light.4.raw

SEQ ID NO: 584283 - DNA, 478 bp, Homo sapiens
  misc_feature: HIJSMM301C4I5J.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctggacgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagtttattactgtcagcagtattgtgaagctccgctcactttcggcggagggaccgcggtggagatcagacgaactgtggctgcaccatctgtctt

SEQ ID NO: 584284 - DNA, 503 bp, Homo sapiens
  misc_feature: HIJSMM301AEYHM.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagcccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctacttcttttctcttcggaactcggaccgacggtcgaccgtcctacggtcgtagcccaacggaccaacccca

SEQ ID NO: 584285 - DNA, 493 bp, Homo sapiens; identical to SEQ ID NO: 536769
  misc_feature: HIJSMM301AV9JE.19.83.H06.1.454.light.4.raw

SEQ ID NO: 584286 - DNA, 484 bp, Homo sapiens; identical to SEQ ID NO: 535211
  misc_feature: HIJSMM301CE2E1.47.46.E02.1.454.light.4.raw

SEQ ID NO: 584287 - DNA, 518 bp, Homo sapiens; identical to SEQ ID NO: 542842
  misc_feature: HIJSMM301DDB30.8.87.H10.1.454.light.4.raw

SEQ ID NO: 584288 - DNA, 474 bp, Homo sapiens
  misc_feature: HIJSMM301EK4RV.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcaccttttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagactttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 584289 - DNA, 484 bp, Homo sapiens; identical to SEQ ID NO: 568521
  misc_feature: HIJSMM301A0P9Q.40.15.B04.1.454.light.4.raw

SEQ ID NO: 584290 - DNA, 489 bp, Homo sapiens; identical to SEQ ID NO: 545019
  misc_feature: HIJSMM301BOD1U.19.57.F02.1.454.light.4.raw

SEQ ID NO: 584291 - DNA, 488 bp, Homo sapiens; identical to SEQ ID NO: 540827
  misc_feature: HIJSMM301CA620.15.49.E05.1.454.light.4.raw

SEQ ID NO: 584292 - DNA, 512 bp, Homo sapiens; identical to SEQ ID NO: 576777
  misc_feature: HIJSMM301CDSVN.48.56.F01.1.454.light.4.raw

SEQ ID NO: 584293 - DNA, 500 bp, Homo sapiens; identical to SEQ ID NO: 539795
  misc_feature: HIJSMM301AV69M.22.38.D05.1.454.light.4.raw

SEQ ID NO: 584294 - DNA, 520 bp, Homo sapiens
  misc_feature: HIJSMM301C3354.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaagggaccgaacggtaggaagtacaaacgaactacgtggctggcaccaactctcgtcttctactcttcccgtcccact

SEQ ID NO: 584295 - DNA, 521 bp, Homo sapiens; identical to SEQ ID NO: 538715
  misc_feature: HIJSMM301AW9HQ.27.23.C01.1.454.light.4.raw

SEQ ID NO: 584296 - DNA, 503 bp, Homo sapiens
  misc_feature: HIJSMM301CQ9DL.9.53.E09.1.454.light.4.raw
tgatacgtctcacgaccggtgctcgatttagagagagtgtgttggggtttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtctaggtcagcccaaggctgcccccg

SEQ ID NO: 584297 - DNA, 494 bp, Homo sapiens; identical to SEQ ID NO: 538796
  misc_feature: HIJSMM301CWJ8J.48.44.D11.1.454.light.4.raw

SEQ ID NO: 584298 - DNA, 479 bp, Homo sapiens
  misc_feature: HIJSMM301ATOUO.48.45.E01.1.454.light.4.raw
agtatacatacacgaccggtgctcgatttagtgagtcagtaagggaaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttatcactatgtctcctggtaccaacagcaccctggcaaagcccccaaactcatgatttatgatatcactaagcggccctcaggggtccctgatcgcttctctggctcccagtctggcaacacggcctccctgaccatctctgggctccaggctgaggatgaggctgattattactgctgctcatatgcaggcagctacactttggtgttcggcggtagggaccaagctgactgtcc

SEQ ID NO: 584299 - DNA, 490 bp, Homo sapiens; identical to SEQ ID NO: 538273
  misc_feature: HIJSMM301C0NOS.16.73.G07.1.454.light.4.raw

SEQ ID NO: 584300 - DNA, 496 bp, Homo sapiens
  misc_feature: HIJSMM301BQJ2Y.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggcctcaggggtttctgttcgcttctctggctccaagtctggcagcacggcctccctgaccatctctgggctccaggctgaggacgaggctgactattattgcagttcatatggtagtaatgaagactcttgtgattttcggcggagggaccaagctgaccgtcctgagtcagcccaaggctccg

SEQ ID NO: 584301 - DNA, 487 bp, Homo sapiens; identical to SEQ ID NO: 537079
  misc_feature: HIJSMM301EF4K4.14.55.E11.1.454.light.4.raw

SEQ ID NO: 584302 - DNA, 479 bp, Homo sapiens
  misc_feature: HIJSMM301D5SHB.40.83.H06.1.454.light.4.raw
tctagcgactcacgaccggtgctcgatttagatcacgtgcgtcgcggggcaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatgggacggcagcctcagtgaatgggtgttcggcggagggaccaaactgtccgtctaggtcag

SEQ ID NO: 584303 - DNA, 441 bp, Homo sapiens; identical to SEQ ID NO: 534971
  misc_feature: HIJSMM301BGJ1J.11.3.A03.1.454.light.4.raw

SEQ ID NO: 584304 - DNA, 516 bp, Homo sapiens
  misc_feature: HIJSMM301A63F0.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaagctgaccgtctaggtcagcccaaggctgccccctcggtcactc

SEQ ID NO: 584305 - DNA, 486 bp, Homo sapiens; identical to SEQ ID NO: 535385
  misc_feature: HIJSMM301EF2XI.19.71.G05.1.454.light.4.raw

SEQ ID NO: 584306 - DNA, 383 bp, Homo sapiens; identical to SEQ ID NO: 447524
  misc_feature: HIJSMM301BHLQS.41.26.C04.1.454.light.4.raw

SEQ ID NO: 584307 - DNA, 494 bp, Homo sapiens; identical to SEQ ID NO: 534994
  misc_feature: HIJSMM301BLAFZ.27.78.H01.1.454.light.4.raw

SEQ ID NO: 584308 - DNA, 489 bp, Homo sapiens; identical to SEQ ID NO: 535091
  misc_feature: HIJSMM301DWZZX.47.36.D03.1.454.light.4.raw

SEQ ID NO: 584309 - DNA, 500 bp, Homo sapiens
  misc_feature: HIJSMM301C81HA.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcgggggcggaacgctgaggatcaaccgaacctagtggcgtgcaccactctgtt

SEQ ID NO: 584310 - DNA, 506 bp, Homo sapiens
  misc_feature: HIJSMM301C7EQ7.40.23.C01.1.454.light.4.raw
tctagcgactcacgaccggtgctcgatttagtacacgtgattagggattggggggggaggaactgctcagttaggacccagagggaaccatggaagccccagctcagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatcttcccgc

SEQ ID NO: 584311 - DNA, 507 bp, Homo sapiens
  misc_feature: HIJSMM301BSDQ0.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatggggacagacttcactctcaccatcatcagcctggagcctgaggatgttgcagtttattactgtcaacatcgtaccgagtggcctccggggccactttcggccctgggaccaaagtggatatcaacgaactgtggctgcaccatctgtcttcta

SEQ ID NO: 584312 - DNA, 506 bp, Homo sapiens; identical to SEQ ID NO: 542696
  misc_feature: HIJSMM301CUZBH.7.71.G05.1.454.light.4.raw

SEQ ID NO: 584313 - DNA, 509 bp, Homo sapiens; identical to SEQ ID NO: 547302
  misc_feature: HIJSMM301DS946.4.57.F02.1.454.light.4.raw

SEQ ID NO: 584314 - DNA, 500 bp, Homo sapiens
  misc_feature: HIJSMM301ASZW5.53.14.B03.1.454.light.4.raw
cgcgtatacacacgaccggtgctcgatttagtgtgagtagttccgcgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcg

SEQ ID NO: 584315 - DNA, 504 bp, Homo sapiens; identical to SEQ ID NO: 535128
  misc_feature: HIJSMM301EXLIP.19.85.H08.1.454.light.4.raw

SEQ ID NO: 584316 - DNA, 491 bp, Homo sapiens; identical to SEQ ID NO: 535294
  misc_feature: HIJSMM301A3C3R.16.68.G02.1.454.light.4.raw

SEQ ID NO: 584317 - DNA, 511 bp, Homo sapiens
  misc_feature: HIJSMM301BDJBS.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacaacggccgctcactttcggcggagggaccgaaggtggaggatcaaacgaaactgtggctgcaccaatctgtt

SEQ ID NO: 584318 - DNA, 504 bp, Homo sapiens; identical to SEQ ID NO: 582363
  misc_feature: HIJSMM301DSRCU.12.48.E04.1.454.light.4.raw

SEQ ID NO: 584319 - DNA, 486 bp, Homo sapiens; identical to SEQ ID NO: 553608
  misc_feature: HIJSMM301AY5XK.11.12.B01.1.454.light.4.raw

SEQ ID NO: 584320 - DNA, 492 bp, Homo sapiens; identical to SEQ ID NO: 535126
  misc_feature: HIJSMM301DCFK9.18.11.A11.1.454.light.4.raw

SEQ ID NO: 584321 - DNA, 499 bp, Homo sapiens; identical to SEQ ID NO: 542528
  misc_feature: HIJSMM301EF4G9.52.34.D01.1.454.light.4.raw

SEQ ID NO: 584322 - DNA, 485 bp, Homo sapiens; identical to SEQ ID NO: 536263
  misc_feature: HIJSMM301C5OPX.47.78.H01.1.454.light.4.raw

SEQ ID NO: 584323 - DNA, 490 bp, Homo sapiens; identical to SEQ ID NO: 543909
  misc_feature: HIJSMM301BJZ4V.14.55.E11.1.454.light.4.raw

SEQ ID NO: 584324 - DNA, 486 bp, Homo sapiens; identical to SEQ ID NO: 535043
  misc_feature: HIJSMM301EQ61X.46.35.D02.1.454.light.4.raw

SEQ ID NO: 584325 - DNA, 515 bp, Homo sapiens
  misc_feature: HIJSMM301AP0UW.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccgtacggaccgaacggtaggaaagtacaagcgaacctagtggcgtgcaccaactctgtcttctactcttcccgt

SEQ ID NO: 584326 - DNA, 467 bp, Homo sapiens
  misc_feature: HIJSMM301APERJ.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtcttccttgtctctcacccctgtagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactgaaaaaccagccgggtggagagtgaccatgttggaacttatta

SEQ ID NO: 584327 - DNA, 492 bp, Homo sapiens
  misc_feature: HIJSMM301D2JYU.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggtcggggggaccaaggtgaccgtcctaggtcagccc

SEQ ID NO: 584328 - DNA, 510 bp, Homo sapiens
  misc_feature: HIJSMM301B25KJ.40.81.H04.1.454.light.4.raw
tctagcgactcacgaccggtgctcgatttagtagtgtagattcgcgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctcctgaccgtctctgggctccaggctgaagatgaggctgattattactgctactcgtatgcaggcggcaacaattgggtcttcggcggagggaccaagctgaccgtcctaggtcagcccaaggctgccccctcggtcactctcg

SEQ ID NO: 584329 - DNA, 486 bp, Homo sapiens; identical to SEQ ID NO: 535043
  misc_feature: HIJSMM301CG5UB.46.35.D02.1.454.light.4.raw

SEQ ID NO: 584330 - DNA, 491 bp, Homo sapiens; identical to SEQ ID NO: 542310
  misc_feature: HIJSMM301DBA1K.22.65.F10.1.454.light.4.raw

SEQ ID NO: 584331 - DNA, 491 bp, Homo sapiens
  misc_feature: HIJSMM301B4J5O.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggtccaacggacacgactggagattaaacgaactgtggctgcaccatctgtcttcat

SEQ ID NO: 584332 - DNA, 487 bp, Homo sapiens; identical to SEQ ID NO: 541583
  misc_feature: HIJSMM301AWVLJ.41.57.F02.1.454.light.4.raw

SEQ ID NO: 584333 - DNA, 482 bp, Homo sapiens; identical to SEQ ID NO: 548071
  misc_feature: HIJSMM301BGTSX.4.74.G08.1.454.light.4.raw

SEQ ID NO: 584334 - DNA, 479 bp, Homo sapiens
  misc_feature: HIJSMM301DUHQ1.10.1.A01.1.454.light.4.raw
catagtagtgcacgaccggtgctcgatttagacgtctcatcaggggtccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacgaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagcgtgaccgtcctaggtc

SEQ ID NO: 584335 - DNA, 500 bp, Homo sapiens
  misc_feature: HIJSMM301ELREI.52.38.D05.1.454.light.4.raw
cgcagtacgacacgaccggtgctcgatttagtatctgatagttgggtttggggaggaactgctcagttaggacccagagggaaccatggaagccccagctcagcttctcttcctcctgctactctggctcccagataccaccggagaagttgtattgacacagtctccagccaccctgtctttgtctccaggggggagagccaccctctcctgcagggccagtcagagtgttggcaacctcttagcctggtaccaacaaaaacctggccaggctcccaggctcctcatctatgatgcatccacgagggccactggcatcccagccaggttcagtggcagtgggtctgagacagacttcactctcaccatcagtggcctcgagcctgaagattttgcagtttattactgtcagcagcgtagccactggctctctttcggcggagggaccaaggttgagatcaaacgaactgtggctgcaccatctgtcttcatcttccccg

SEQ ID NO: 584336 - DNA, 493 bp, Homo sapiens; identical to SEQ ID NO: 540127
  misc_feature: HIJSMM301DC9JY.10.17.B06.1.454.light.4.raw

SEQ ID NO: 584337 - DNA, 492 bp, Homo sapiens
  misc_feature: HIJSMM301BNTHT.18.11.A11.1.454.light.4.raw
  modified_base (463)..(463): a, c, t, g, unknown or other
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactgtggntgcaccatctgtcttcatccttcccgcat

SEQ ID NO: 584338 - DNA, 490 bp, Homo sapiens
  misc_feature: HIJSMM301EE3R9.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttccccgccctcctc

SEQ ID NO: 584339 - DNA, 493 bp, Homo sapiens
  misc_feature: HIJSMM301BPPTS.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcagcttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactggtggctgcaccat

SEQ ID NO: 584340 - DNA, 453 bp, Homo sapiens
  misc_feature: HIJSMM301CLB93.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttccaccctcctccacgagagta

SEQ ID NO: 584341 - DNA, 513 bp, Homo sapiens
  misc_feature: HIJSMM301D3OLB.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaacgcccccaaactcatcatttatgagaccactaagcggccctcgaggggtttctgatcgcttctctgcctccaagtctggccacacggcctccctgacaatctctgggctccagactgaggacgagggtgattattactgctgctcatacggaggactagaactttgctattcggcggagggaccaagttgaccgtcctaagtcagccaaggctcgccccctcggtcactctgtt

SEQ ID NO: 584342 - DNA, 498 bp, Homo sapiens
  misc_feature: HIJSMM301AF6Q0.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggtcggagggaccaagctgaccgtcctaggtcagcccaaggctgccccctcggt

SEQ ID NO: 584343 - DNA, 489 bp, Homo sapiens
  misc_feature: HIJSMM301AONU0.5.53.E09.1.454.light.4.raw
atcagacacgcacgaccggtgctcgatttagagagagtgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgacccttcggtccaacgggacgacgactggaggattaaacgtaactagtggctg

SEQ ID NO: 584344 - DNA, 487 bp, Homo sapiens
  misc_feature: HIJSMM301AFKQK.49.7.A07.1.454.light.4.raw
agtcgagagacacgaccggtgctcgatttagcacgtgtcgcaggggccttcaggccataatgagcgtctctgttttcagggtctctctcccagcctgtggtgactcaatcatcctctgcctctgcttccctgggatcctcggtcaagctcacctgcactctgagcagtgggcacagtacctacatcatcgcatggcataccagcagccagggaaggcccctcggtacttgatgaagcttgaacgtagtggaagcaacaacatggggggcggagttcctgatcgcttctcaggctccagttctgggcctgacttctacctcaccatctccagcctccagtctgaggatgaggctgattattactgtgagacctgggacagtaacactcatactccctcattcggcggagggaccaagctgaccgtcctaggtcagcccaaggctcgccccctcggtcactctgttccccaccctcctctctctcgact

SEQ ID NO: 584345 - DNA, 476 bp, Homo sapiens
  misc_feature: HIJSMM301C1CKY.12.1.A01.1.454.light.4.raw
atacgacgtacacgaccggtgctcgatttagacgtctcatcaggggagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaacagagtaacagttaccctccaactttcggcggagggaccaaggtggagatcaaacgaactgtggctgcaccatctgtt

SEQ ID NO: 584346 - DNA, 506 bp, Homo sapiens; identical to SEQ ID NO: 534969
  misc_feature: HIJSMM301DG872.18.37.D04.1.454.light.4.raw

SEQ ID NO: 584347 - DNA, 477 bp, Homo sapiens
  misc_feature: HIJSMM301B969X.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggtccagggaccgaaagtggatgtcaaccgaactgtggctgcacca

SEQ ID NO: 584348 - DNA, 509 bp, Homo sapiens
  misc_feature: HIJSMM301DMT5Q.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggtaccaaaggtggaaatcaaacgaactgtggctgcaccatctgtcttcatcttcccgcc

SEQ ID NO: 584349 - DNA, 490 bp, Homo sapiens
  misc_feature: HIJSMM301EZJZ5.40.11.A11.1.454.light.4.raw
tctagcgactcacgaccggtgctcgatttagctacgactgcagggaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcggtctgggacagatttcactctgaccatcagcagcctgcaggctgaagatgtggcagtttatactgtcaacaatattatactactccgctcactttcggcggaggcaccaaggtggagatcagacgaactgtggctgcaccatctgtcttcatcttcccg

SEQ ID NO: 584350 - DNA, 502 bp, Homo sapiens
  misc_feature: HIJSMM301ENSE6.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacactttgcagtttatttctgtcagcagtctgaagctggccgttcactttcggcggagggaccaaggtggacctcaaacgaactgtggctgcaccatctgtcttcatcttccgcc

SEQ ID NO: 584351 - DNA, 519 bp, Homo sapiens
  misc_feature: HIJSMM301BICPY.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctggtggggcaggtcagcccaaggctgccccctcggtcactctgttcccgccctcctccacg

SEQ ID NO: 584352 - DNA, 476 bp, Homo sapiens
  misc_feature: HIJSMM301D4014.13.76.G10.1.454.light.4.raw
tcacgtactacacgaccggtgctcgatttagtcactcatacaggggctgggcctcaggaagcagcaacggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggaccaggctatggatgaggctgactattactgtcaggcgtgggacagcagcactgcccgctatgtcttcggaactgggaccaaggtcaccgtcctaagtcacgcccaac

SEQ ID NO: 584353 - DNA, 492 bp, Homo sapiens; identical to SEQ ID NO: 556964
  misc_feature: HIJSMM301DS7IG.26.78.H01.1.454.light.4.raw

SEQ ID NO: 584354 - DNA, 492 bp, Homo sapiens
  misc_feature: HIJSMM301BNS53.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacacgtacccccctcacctttcggcggagggaccaaggcggagatcagacgaactgtggctgcaccatctgtcttcta

SEQ ID NO: 584355 - DNA, 488 bp, Homo sapiens; identical to SEQ ID NO: 540827
  misc_feature: HIJSMM301ELX83.15.49.E05.1.454.light.4.raw

SEQ ID NO: 584356 - DNA, 496 bp, Homo sapiens; identical to SEQ ID NO: 536802
  misc_feature: HIJSMM301AGBBV.5.24.C02.1.454.light.4.raw

SEQ ID NO: 584357 - DNA, 522 bp, Homo sapiens
  misc_feature: HIJSMM301BI5ZS.40.27.C05.1.454.light.4.raw
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggcagcaggttaccgtctcttgttctggaagcagctccaacatcggaagtaattctgtatactggtaccagtgcctcccaggaaccggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactcttccg

SEQ ID NO: 584358 - DNA, 494 bp, Homo sapiens; identical to SEQ ID NO: 576031
  misc_feature: HIJSMM301BZU3P.12.23.C01.1.454.light.4.raw

SEQ ID NO: 584359 - DNA, 498 bp, Homo sapiens; identical to SEQ ID NO: 547576
  misc_feature: HIJSMM301DUGZ5.12.37.D04.1.454.light.4.raw

SEQ ID NO: 584360 - DNA, 514 bp, Homo sapiens; identical to SEQ ID NO: 554167
  misc_feature: HIJSMM301AWPNW.40.12.B01.1.454.light.4.raw

SEQ ID NO: 584361 - DNA, 513 bp, Homo sapiens
  misc_feature: HIJSMM301AUNLZ.48.37.D04.1.454.light.4.raw
agtatacatacacgaccggtgctcgatttagtagcatactgttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaaagaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctcgttcccaccct

SEQ ID NO: 584362 - DNA, 482 bp, Homo sapiens
  misc_feature: HIJSMM301EXP0A.4.10.A10.1.454.light.4.raw
agcactgtagcacgaccggtgctcgatttagcgtcgatctcaggggagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcggagggaccaaggtggaaatcaaacgaactgtggctgcaccatctgtcttcta

SEQ ID NO: 584363 - DNA, 499 bp, Homo sapiens; identical to SEQ ID NO: 535899
  misc_feature: HIJSMM301DYWRH.19.78.H01.1.454.light.4.raw

SEQ ID NO: 584364 - DNA, 491 bp, Homo sapiens
  misc_feature: HIJSMM301ET42Y.53.4.A04.1.454.light.4.raw
  modified_base (455)..(455): a, c, t, g, unknown or other
cgcgtatacacacgaccggtgctcgatttagagtagtgatcagggggcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggttatcatctcctgcactgggaccagctccaacatcgggtcaggttatgatgtacactggtaccagcagcttccaggaacagcccccaaactcctcgtctatggtgacggcagtcggccctcaggggtccctggccgattctctggctccaagtctggcacctcagcctccctggccatcactgggctccaggctgaggatgagggtcattattactgccagtcctatgacaacagaatggatccttcttgggtnttcggcggagggaccaagctgaccgtctacgtcacg

SEQ ID NO: 584365 - DNA, 503 bp, Homo sapiens; identical to SEQ ID NO: 569603
  misc_feature: HIJSMM301AYFVX.16.9.A09.1.454.light.4.raw

SEQ ID NO: 584366 - DNA, 507 bp, Homo sapiens
  misc_feature: HIJSMM301AIHYV.10.27.C05.1.454.light.4.raw
catagtagtgcacgaccggtgctcgatttagacgcgatcgaaggggtttggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggggtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggt

SEQ ID NO: 584367 - DNA, 521 bp, Homo sapiens
  misc_feature: HIJSMM301BIY8O.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 584368 - DNA, 503 bp, Homo sapiens; identical to SEQ ID NO: 536834
  misc_feature: HIJSMM301BLLC0.2.35.D02.1.454.light.4.raw

SEQ ID NO: 584369 - DNA, 484 bp, Homo sapiens
  misc_feature: HIJSMM301BH316.49.25.C03.1.454.light.4.raw
agtcgagagacacgaccggtgctcgatttagtagtgtagatttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcgggggaccgaaggtggagatcaaacgaactgtggctgcaccat

SEQ ID NO: 584370 - DNA, 499 bp, Homo sapiens
  misc_feature: HIJSMM301CQPI1.51.80.H03.1.454.light.4.raw
cgatcgtatacacgaccggtgctcgatttagctgtgcgtcgaagggaaaggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctcctgaccgtctctgggctccaggctgaggatgaggctgattattactgctgctcacatgcaggcagcatcggtgtgctattcggcggagggaccaagctgaccgtcctaggtcagcccaaggctgtccccccg

SEQ ID NO: 584371 - DNA, 479 bp, Homo sapiens; identical to SEQ ID NO: 542895
  misc_feature: HIJSMM301CRGHF.40.59.F04.1.454.light.4.raw

SEQ ID NO: 584372 - DNA, 384 bp, Homo sapiens
  misc_feature: HIJSMM301AI0E6.49.42.D09.1.454.light.4.raw
agtcgagagacacgaccggtgctcgatttagacacatacgcagggaaagggggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtcgttataactttgtctcctggtaccagcaacacccaggcaacttcgcttttgtcttcggaactgggaccgagggtcaccgtcctgggtcagcccaaggccaaccccactgtcactctgttcccaccctcctctctctcgact

SEQ ID NO: 584373 - DNA, 489 bp, Homo sapiens
  misc_feature: HIJSMM301DTOHM.49.68.G02.1.454.light.4.raw
agtcgagagacacgaccggtgctcgatttagtcgatagtgaaggggaaagggggatcaggactcctcagttcaccttctcacaatgaggctccctgctcagctcctggggctgctaatgctctgggtctctggttccagtggggatattgtgatgactcagtctccactctccctgcccgtcacccctggagagccggcctccatctcctgcaggtctagtcagagcctcctgcatagcaatggatacaactatttggattggtacctgcagaagccagggcaggctccacagctcctgatctatttgggttcgaatcgggcctccgggtccctgacaggttcagtggcagtggatcaggcacagattttacactgaaaatcagcagagtggaggctgaggatgttgggatttattactgcatgcaagctctacaagctcctcagctcactttcggcggagggaccaaggtcggagatcaaacgaactc

SEQ ID NO: 584374 - DNA, 494 bp, Homo sapiens; identical to SEQ ID NO: 544718
  misc_feature: HIJSMM301BL1TL.47.64.F09.1.454.light.4.raw

SEQ ID NO: 584375 - DNA, 508 bp, Homo sapiens
  misc_feature: HIJSMM301DLY3E.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccggggccactttcggccctgggaccaaagtggatatcaaacgaactagtggctgcaccatctgtcttcta

SEQ ID NO: 584376 - DNA, 495 bp, Homo sapiens; identical to SEQ ID NO: 569736
  misc_feature: HIJSMM301BV5KJ.13.39.D06.1.454.light.4.raw

SEQ ID NO: 584377 - DNA, 504 bp, Homo sapiens
  misc_feature: HIJSMM301BXJC5.22.21.B10.1.454.light.4.raw
acatacgcgtcacgaccggtgctcgatttagtgtcgtcgcaaggggggggtcgtcaggaggcagcgctctcaggacgtcaccaccatggcctgggctctgctcctcctcagcctcctcactcagggcacagggtccgtgggcccgagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcact

SEQ ID NO: 584378 - DNA, 483 bp, Homo sapiens; identical to SEQ ID NO: 542674
  misc_feature: HIJSMM301B1HPH.21.25.C03.1.454.light.4.raw

SEQ ID NO: 584379 - DNA, 507 bp, Homo sapiens
  misc_feature: HIJSMM301DPYF7.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccggttc

SEQ ID NO: 584380 - DNA, 478 bp, Homo sapiens
  misc_feature: HIJSMM301DWVP9.13.5.A05.1.454.light.4.raw
tcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaaatggatatacctatttggattggtatctgcagaagccagggcagtctccacaactcctgatctattggggttctaatcgggcctccggggtccctgacaggttcagtggcagtggatcaggcacagattttacactgaaaatcagcagagtggaggctgaggatgttggggtttattactgcatgcaagctctacaaactctgcggactttcggccctggaccaaagtggagatcaaacgaa

SEQ ID NO: 584381 - DNA, 511 bp, Homo sapiens; identical to SEQ ID NO: 557489
  misc_feature: HIJSMM301EX5C6.41.9.A09.1.454.light.4.raw

SEQ ID NO: 584382 - DNA, 487 bp, Homo sapiens
  misc_feature: HIJSMM301AP7UP.49.61.F06.1.454.light.4.raw
agtcgagagacacgaccggtgctcgatttagctacgctctaagggaaagggggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagatattgcaacatattactgtcaacagtatgatcgtctcccgctcactttcggcgggggaccaaggtggagatcaagcgaactgtggctgcacc

SEQ ID NO: 584383 - DNA, 494 bp, Homo sapiens; identical to SEQ ID NO: 534992
  misc_feature: HIJSMM301AC9CU.9.1.A01.1.454.light.4.raw

SEQ ID NO: 584384 - DNA, 509 bp, Homo sapiens; identical to SEQ ID NO: 540045
  misc_feature: HIJSMM301BPJYK.11.57.F02.1.454.light.4.raw

SEQ ID NO: 584385 - DNA, 509 bp, Homo sapiens; identical to SEQ ID NO: 539269
  misc_feature: HIJSMM301CS637.4.57.F02.1.454.light.4.raw

SEQ ID NO: 584386 - DNA, 494 bp, Homo sapiens; identical to SEQ ID NO: 539922
  misc_feature: HIJSMM301ANV7W.27.78.H01.1.454.light.4.raw

SEQ ID NO: 584387 - DNA, 454 bp, Homo sapiens
  misc_feature: HIJSMM301BG1V1.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcattgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccccactgtcactctgttcccgccctcctccatactcgta

SEQ ID NO: 584388 - DNA, 416 bp, Homo sapiens; identical to SEQ ID NO: 539343
  misc_feature: HIJSMM301E2NUY.18.78.H01.1.454.light.4.raw

SEQ ID NO: 584389 - DNA, 494 bp, Homo sapiens; identical to SEQ ID NO: 578282
  misc_feature: HIJSMM301CSPVW.16.53.E09.1.454.light.4.raw

SEQ ID NO: 584390 - DNA, 494 bp, Homo sapiens
  misc_feature: HIJSMM301CFLP1.3.35.D02.1.454.light.4.raw
agacgcactccacgaccggtgctcgatttagcacacgatagttgggtttggggactgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggatttatttcttgcatgcaagctacacactggccgtacacttttggtccaggggaccaagctggagatcaaacgaactgtgg

SEQ ID NO: 584391 - DNA, 502 bp, Homo sapiens
  misc_feature: HIJSMM301B7G7N.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattatttctgcagctcatacacaaccggcaccactgtcgtggttttcggtggagggaccaagctgaccgtcctaggtcagcccaaggctgccccctcggtcactctgttcccaccctcctcgagtgcgtct

SEQ ID NO: 584392 - DNA, 508 bp, Homo sapiens; identical to SEQ ID NO: 535835
  misc_feature: HIJSMM301ECLT8.8.34.D01.1.454.light.4.raw

SEQ ID NO: 584393 - DNA, 496 bp, Homo sapiens; identical to SEQ ID NO: 551761
  misc_feature: HIJSMM301EICR8.4.27.C05.1.454.light.4.raw

SEQ ID NO: 584394 - DNA, 483 bp, Homo sapiens; identical to SEQ ID NO: 555750
  misc_feature: HIJSMM301B6L2M.41.78.H01.1.454.light.4.raw

SEQ ID NO: 584395 - DNA, 495 bp, Homo sapiens
  misc_feature: HIJSMM301BG6HP.48.44.D11.1.454.light.4.raw
agtatacatacacgaccggtgctcgatttagcgcagtacgaagggggagctacaacaggcaggcaggggcagcaagatggtgttgcagacccaggtcttcatttctctgttgctctggatctctggtgcctacggggacgtcgtgatgacccagtctccagactccctggcagtgtctctgggcgggagggccaccatcaactgcaagtccagccagagtattttatacagctcctacaataagagcgacttagcttggtaccagcagaaaccaggacagcctcctaagttgctcatttactgggcatctaaccggcaatccggggtccctgaccgattcagtggcagcgggtctgggacacatttcgctttcaccatcagcagcctgcaggctgaggatgtggcagtttattactgtcagcaatattatactactccgtggactttcggccaagggaccaaggtggaaatcagacgaactagtggctgcaccat

SEQ ID NO: 584396 - DNA, 503 bp, Homo sapiens; identical to SEQ ID NO: 535044
  misc_feature: HIJSMM301AG8L1.19.78.H01.1.454.light.4.raw

SEQ ID NO: 584397 - DNA, 499 bp, Homo sapiens; identical to SEQ ID NO: 536578
  misc_feature: HIJSMM301AW43J.22.27.C05.1.454.light.4.raw

SEQ ID NO: 584398 - DNA, 499 bp, Homo sapiens
  misc_feature: HIJSMM301AJC5G.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggtttccgaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 584399 - DNA, 514 bp, Homo sapiens
  misc_feature: HIJSMM301DP7O3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaaggtacggaagtacgaaacgaactagtggctgcaccactctgtcttctatcttcccgtccact

SEQ ID NO: 584400 - DNA, 501 bp, Homo sapiens; identical to SEQ ID NO: 555551
  misc_feature: HIJSMM301BL4UX.21.81.H04.1.454.light.4.raw

SEQ ID NO: 584401 - DNA, 484 bp, Homo sapiens; identical to SEQ ID NO: 535400
  misc_feature: HIJSMM301AQA4K.46.26.C04.1.454.light.4.raw

SEQ ID NO: 584402 - DNA, 491 bp, Homo sapiens; identical to SEQ ID NO: 551092
  misc_feature: HIJSMM301EUFA5.51.71.G05.1.454.light.4.raw

SEQ ID NO: 584403 - DNA, 447 bp, Homo sapiens
  misc_feature: HIJSMM301C3JS9.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtcccgtcgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccacccctcctccgtgtctgat

SEQ ID NO: 584404 - DNA, 493 bp, Homo sapiens; identical to SEQ ID NO: 544773
  misc_feature: HIJSMM301CBFJN.21.47.E03.1.454.light.4.raw

SEQ ID NO: 584405 - DNA, 480 bp, Homo sapiens
  misc_feature: HIJSMM301DGY7J.49.85.H08.1.454.light.4.raw
agtcgagagacacgaccggtgctcgatttagtatcactcagtcgcgggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggaggaccacggtggagatcaaacgaactgtggctgcaccatctgtctt

SEQ ID NO: 584406 - DNA, 504 bp, Homo sapiens; identical to SEQ ID NO: 539091
  misc_feature: HIJSMM301BRP1G.8.28.C06.1.454.light.4.raw

SEQ ID NO: 584407 - DNA, 505 bp, Homo sapiens; identical to SEQ ID NO: 539292
  misc_feature: HIJSMM301C82N7.19.85.H08.1.454.light.4.raw

SEQ ID NO: 584408 - DNA, 479 bp, Homo sapiens
  misc_feature: HIJSMM301BTQ9S.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacaacaccctgcgtggttttggctggttcgcggcggac

SEQ ID NO: 584409 - DNA, 503 bp, Homo sapiens; identical to SEQ ID NO: 536834
  misc_feature: HIJSMM301AU6QX.2.35.D02.1.454.light.4.raw

SEQ ID NO: 584410 - DNA, 482 bp, Homo sapiens; identical to SEQ ID NO: 536622
  misc_feature: HIJSMM301ANJ0N.7.85.H08.1.454.light.4.raw

SEQ ID NO: 584411 - DNA, 520 bp, Homo sapiens
  misc_feature: HIJSMM301DSTCK.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacggaccgaacggtaggaaggtacaacgaactagtggctgcaccactctgtcttctatcttcccgtccactctgtat

SEQ ID NO: 584412 - DNA, 489 bp, Homo sapiens; identical to SEQ ID NO: 558034
  misc_feature: HIJSMM301BK0GF.8.12.B01.1.454.light.4.raw

SEQ ID NO: 584413 - DNA, 502 bp, Homo sapiens; identical to SEQ ID NO: 541501
  misc_feature: HIJSMM301B96MW.17.27.C05.1.454.light.4.raw

SEQ ID NO: 584414 - DNA, 497 bp, Homo sapiens; identical to SEQ ID NO: 568187
  misc_feature: HIJSMM301B1CE1.48.31.C09.1.454.light.4.raw

SEQ ID NO: 584415 - DNA, 510 bp, Homo sapiens
  misc_feature: HIJSMM301CJ91W.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggcttggttcggcgggagggaaccaaactcgaccgtcttaggtcacgcccaaggctcgtccccccg

SEQ ID NO: 584416 - DNA, 495 bp, Homo sapiens; identical to SEQ ID NO: 538651
  misc_feature: HIJSMM301EKP13.10.79.H02.1.454.light.4.raw

SEQ ID NO: 584417 - DNA, 502 bp, Homo sapiens
  misc_feature: HIJSMM301DFC8H.3.33.C11.1.454.light.4.raw
  modified_base (499)..(499): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaaccagcagtgacattggtgattataactatgtctcctggtaccagcagcacccaggcaaaagcccccaaaactcatgatttatgaggtcacaaagcggccctcaggggtccctgatcgcttctctgcctccaagtctggcaacacggcctccctgaccgtctctgggctccagcctgaggatgaggctgatttatactgcagctcatatgcaggcatacaacaactgttttcggtcggagggaccgaagactgacgtcctacggtcagccccaagcgcgcccgccccgtcgtcctctcttcctccctccctccncgt

SEQ ID NO: 584418 - DNA, 479 bp, Homo sapiens
  misc_feature: HIJSMM301A07SQ.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaaactgtggctgcaccat

SEQ ID NO: 584419 - DNA, 489 bp, Homo sapiens
  misc_feature: HIJSMM301B0UFY.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcaggtgggtctgggacagacttcattctcaccatcagcagcctagagcctgaagtattttgcagtttattactgtcagcagcgtagcaactggctcatcaccttcggccaagggacacgactggagatgaaacgaactgtggctgcaccta

SEQ ID NO: 584420 - DNA, 493 bp, Homo sapiens; identical to SEQ ID NO: 535745
  misc_feature: HIJSMM301CPH4K.47.78.H01.1.454.light.4.raw

SEQ ID NO: 584421 - DNA, 504 bp, Homo sapiens; identical to SEQ ID NO: 547181
  misc_feature: HIJSMM301CZXKI.14.57.F02.1.454.light.4.raw

SEQ ID NO: 584422 - DNA, 498 bp, Homo sapiens; identical to SEQ ID NO: 547944
  misc_feature: HIJSMM301DMOXV.41.53.E09.1.454.light.4.raw

SEQ ID NO: 584423 - DNA, 495 bp, Homo sapiens; identical to SEQ ID NO: 545773
  misc_feature: HIJSMM301BP5BB.27.78.H01.1.454.light.4.raw

SEQ ID NO: 584424 - DNA, 491 bp, Homo sapiens; identical to SEQ ID NO: 536211
  misc_feature: HIJSMM301CDAKE.16.53.E09.1.454.light.4.raw

SEQ ID NO: 584425 - DNA, 491 bp, Homo sapiens; identical to SEQ ID NO: 563425
  misc_feature: HIJSMM301BY6FZ.43.82.H05.1.454.light.4.raw

SEQ ID NO: 584426 - DNA, 505 bp, Homo sapiens
  misc_feature: HIJSMM301DLRU6.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgcaacaatatgatatttattctccagcgttcggtccacggggaccgaaacggtagggaagtacgaagacggaaactagttggctggcacccaatctgtt

SEQ ID NO: 584427 - DNA, 493 bp, Homo sapiens
  misc_feature: HIJSMM301ECD05.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttattttgctgctcttatgcaggcagtttcgctctcgagtgttcggcggagggaccgagctgaccgtcctacgtcagcccaa

SEQ ID NO: 584428 - DNA, 488 bp, Homo sapiens; identical to SEQ ID NO: 536554
  misc_feature: HIJSMM301C2B3Y.26.37.D04.1.454.light.4.raw

SEQ ID NO: 584429 - DNA, 497 bp, Homo sapiens; identical to SEQ ID NO: 564845
  misc_feature: HIJSMM301ER4FP.41.18.B07.1.454.light.4.raw

SEQ ID NO: 584430 - DNA, 489 bp, Homo sapiens
  misc_feature: HIJSMM301BM8LF.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagattttgcagtttattactgtcagcagcgtagcactggcctctcaccttcggcggagggaccaaggtggagatcaaacgactgtggctgcaccatctgtt

SEQ ID NO: 584431 - DNA, 501 bp, Homo sapiens
  misc_feature: HIJSMM301A9HGS.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggcaaccccactgtca

SEQ ID NO: 584432 - DNA, 519 bp, Homo sapiens
  misc_feature: HIJSMM301BKSLU.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtctaggtcagcccaaggctgccccctcggtcactctgttcccaccctcctct

SEQ ID NO: 584433 - DNA, 484 bp, Homo sapiens; identical to SEQ ID NO: 535240
  misc_feature: HIJSMM301A7S9X.47.60.F05.1.454.light.4.raw

SEQ ID NO: 584434 - DNA, 504 bp, Homo sapiens; identical to SEQ ID NO: 535495
  misc_feature: HIJSMM301AQWSX.14.86.H09.1.454.light.4.raw

SEQ ID NO: 584435 - DNA, 509 bp, Homo sapiens; identical to SEQ ID NO: 543772
  misc_feature: HIJSMM301A7N2P.2.21.B10.1.454.light.4.raw

SEQ ID NO: 584436 - DNA, 492 bp, Homo sapiens
  misc_feature: HIJSMM301DCB5N.4.52.E08.1.454.light.4.raw
agcactgtagcacgaccggtgctcgatttagtcgagctctcagagagaaaggggcagagccctggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccaaggtggagatacaaacgaactgt

SEQ ID NO: 584437 - DNA, 499 bp, Homo sapiens
  misc_feature: HIJSMM301B1X29.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctcgatcaccttcggccaagggacacgactggagattaaacgaactgtggctgcaccatctgtcttcatt

SEQ ID NO: 584438 - DNA, 486 bp, Homo sapiens; identical to SEQ ID NO: 535385
  misc_feature: HIJSMM301DRCAC.19.71.G05.1.454.light.4.raw

SEQ ID NO: 584439 - DNA, 504 bp, Homo sapiens
  misc_feature: HIJSMM301BJJT8.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataattctgggtgttcggcggagggaccaaactgaccgtcctaggtcagcccaaggctcgccccctcggtcactctgtt

SEQ ID NO: 584440 - DNA, 486 bp, Homo sapiens; identical to SEQ ID NO: 535385
  misc_feature: HIJSMM301D0Q39.19.71.G05.1.454.light.4.raw

SEQ ID NO: 584441 - DNA, 513 bp, Homo sapiens
  misc_feature: HIJSMM301DXLDV.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggcctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccaagtgaccgtcctaaggtcagcccaaggctcgccccctcggtcactctgttcccaccctcctcta

SEQ ID NO: 584442 - DNA, 495 bp, Homo sapiens; identical to SEQ ID NO: 535143
  misc_feature: HIJSMM301BDLCT.51.29.C07.1.454.light.4.raw

SEQ ID NO: 584443 - DNA, 489 bp, Homo sapiens
  misc_feature: HIJSMM301AWWGT.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactccttacacttttggccaggggccaagctggagatcaaacgaactgt

SEQ ID NO: 584444 - DNA, 484 bp, Homo sapiens; identical to SEQ ID NO: 566663
  misc_feature: HIJSMM301EEAZY.49.55.E11.1.454.light.4.raw

SEQ ID NO: 584445 - DNA, 416 bp, Homo sapiens; identical to SEQ ID NO: 536892
  misc_feature: HIJSMM301ARCIQ.16.46.E02.1.454.light.4.raw

SEQ ID NO: 584446 - DNA, 476 bp, Homo sapiens
  misc_feature: HIJSMM301BR72G.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtgggtcccatcaaggttcagcggcagtggatctggcacagacttcattctcaccatcagcagcctgcagcctgaagtattttgcaacttattactgtctacaagatcacaattactcctgggtacgttcggccgaaggaccaaggtaggaatacaaacgaa

SEQ ID NO: 584447 - DNA, 486 bp, Homo sapiens
  misc_feature: HIJSMM301ECH78.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctcgttcccccctcctcgctacgtaga

SEQ ID NO: 584448 - DNA, 513 bp, Homo sapiens; identical to SEQ ID NO: 543313
  misc_feature: HIJSMM301DRJPL.22.36.D03.1.454.light.4.raw

SEQ ID NO: 584449 - DNA, 490 bp, Homo sapiens
  misc_feature: HIJSMM301DH2TR.17.21.B10.1.454.light.4.raw
  modified_base (482)..(482): a, c, t, g, unknown or other
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactntggctgca

SEQ ID NO: 584450 - DNA, 491 bp, Homo sapiens
  misc_feature: HIJSMM301B2JY8.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccagggtggagatcaaacgaactgtggctgcacatctgtcttcat

SEQ ID NO: 584451 - DNA, 485 bp, Homo sapiens
  misc_feature: HIJSMM301DSK6F.43.76.G10.1.454.light.4.raw
tgtgagtagtcacgaccggtgctcgatttagtcactcatacagggggcgggggtaagaggttgtgtccaccatggcctggactcctctcctcctcctgttcctctctcactgcacaggttccctctcgcaggctgtgctgactcagccgtcttccctctctgcatctcctggagcatcagccagtctcacctgcaccttgcgcagtggcatcaatgttgctacccacacaatatactggtaccagcagaagtcagggagtcctccccagtttctcctgaggtacaaatcagactcagataagcagcagggctctggaatccccagccgtttctctggatccaaggatgcttcggccaatgcaggaattttgctcatctctgggctccagtctgaggatgaggctgactattactgtacgatttggcacaacgacgctgtggttttcggcggagggaccaagctgaccgtcctaagtcagcccaac

SEQ ID NO: 584452 - DNA, 505 bp, Homo sapiens; identical to SEQ ID NO: 539033
  misc_feature: HIJSMM301APQX2.22.21.B10.1.454.light.4.raw

SEQ ID NO: 584453 - DNA, 492 bp, Homo sapiens
  misc_feature: HIJSMM301ETR8F.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcaccccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactgt

SEQ ID NO: 584454 - DNA, 467 bp, Homo sapiens; identical to SEQ ID NO: 562413
  misc_feature: HIJSMM301AUHXW.3.20.B09.1.454.light.4.raw

SEQ ID NO: 584455 - DNA, 492 bp, Homo sapiens
  misc_feature: HIJSMM301D568B.51.81.H04.1.454.light.4.raw
cgatcgtatacacgaccggtgctcgatttagtagtgtagattcgcggggggggagcctagctgtgctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaac

SEQ ID NO: 584456 - DNA, 472 bp, Homo sapiens; identical to SEQ ID NO: 535992
  misc_feature: HIJSMM301EEQQP.11.76.G10.1.454.light.4.raw

SEQ ID NO: 584457 - DNA, 503 bp, Homo sapiens
  misc_feature: HIJSMM301DEH9N.40.67.G01.1.454.light.4.raw
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctggcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgactgtggctgcaccatctgtcttcatcttccgc

SEQ ID NO: 584458 - DNA, 488 bp, Homo sapiens; identical to SEQ ID NO: 537260
  misc_feature: HIJSMM301D25E3.47.70.G04.1.454.light.4.raw

SEQ ID NO: 584459 - DNA, 508 bp, Homo sapiens; identical to SEQ ID NO: 550253
  misc_feature: HIJSMM301A86K7.9.55.E11.1.454.light.4.raw

SEQ ID NO: 584460 - DNA, 440 bp, Homo sapiens
  misc_feature: HIJSMM301CK52H.51.78.H01.1.454.light.4.raw
cgatcgtatacacgaccggtgctcgatttagtgtgagtagtttgggtttgggtagtttgggtttggggctttccccagtctccatcctccctgtctgcatctgtaggagacagagtcaccatcacttgccgggcaagtcagagcattagcagctatttaaattggtatcagcagagaccagggaaagccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccaaaggtggagatcaaacgaactgtggcttgcaccatctgtcttcatcttcccgccatctgatcgtaggcact

SEQ ID NO: 584461 - DNA, 486 bp, Homo sapiens; identical to SEQ ID NO: 535385
  misc_feature: HIJSMM301AXE66.19.71.G05.1.454.light.4.raw

SEQ ID NO: 584462 - DNA, 514 bp, Homo sapiens
  misc_feature: HIJSMM301ECTNS.5.59.F04.1.454.light.4.raw
atcagacacgcacgaccggtgctcgatttagtacacacacttagggattggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccaagggaccaaggtgggaaatacaaacgaaacctagtggcgtgcgaccaactctgtcttctactcttccccg

SEQ ID NO: 584463 - DNA, 444 bp, Homo sapiens
  misc_feature: HIJSMM301CERU2.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgtcccacccctcctccgtgtctgat

SEQ ID NO: 584464 - DNA, 503 bp, Homo sapiens
  misc_feature: HIJSMM301E2TAY.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcagtttattattgtcagcagtataataactggcctccgtggacgttcggccaagggaccaaggtggaaagtcaaacggaactaggtggctgcaccatctgtcttcta

SEQ ID NO: 584465 - DNA, 508 bp, Homo sapiens
  misc_feature: HIJSMM301BFDNQ.48.81.H04.1.454.light.4.raw
agtatacatacacgaccggtgctcgatttagtagtgtagattcgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggaccggtggaaataaaacgaactgtggctgcaccatctgtcttcta

SEQ ID NO: 584466 - DNA, 475 bp, Homo sapiens
  misc_feature: HIJSMM301ALL05.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctcgccccctcggtcactctcgttcccaccctcctcgctacgtaga

SEQ ID NO: 584467 - DNA, 491 bp, Homo sapiens
  misc_feature: HIJSMM301AT0WS.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttgccgggggaccaagctggaaatcaagcgaactgtggctgcaccatctgtcttcat

SEQ ID NO: 584468 - DNA, 489 bp, Homo sapiens; identical to SEQ ID NO: 536663
  misc_feature: HIJSMM301CFVTD.16.72.G06.1.454.light.4.raw

SEQ ID NO: 584469 - DNA, 500 bp, Homo sapiens
  misc_feature: HIJSMM301BWZIT.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcgaccgaagggaccaaggtggaaatcaaaacgaactggtggctgcacct

SEQ ID NO: 584470 - DNA, 489 bp, Homo sapiens
  misc_feature: HIJSMM301BMCPB.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggccagtctccaaagctcctcatcaagtatgcttctcagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacga

SEQ ID NO: 584471 - DNA, 523 bp, Homo sapiens
  misc_feature: HIJSMM301AMJNQ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggggtgttcggcggagggaccaggctgaccgtcctaggtcacgccaaggctgccccctcggtcactctgttcccaccct

SEQ ID NO: 584472 - DNA, 502 bp, Homo sapiens; identical to SEQ ID NO: 541501
  misc_feature: HIJSMM301AK33W.17.27.C05.1.454.light.4.raw

SEQ ID NO: 584473 - DNA, 492 bp, Homo sapiens
  misc_feature: HIJSMM301CBF10.48.1.A01.1.454.light.4.raw
  modified_base (408)..(408): a, c, t, g, unknown or other
agtatacatacacgaccggtgctcgatttagacgtctcatcagggggcaggagtcagacccagccaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcancagggtgacagtttccctcccactttcggcggagggaccagggtggacgtcaaacgaactgtggctgcaccatctgtcttcatt

SEQ ID NO: 584474 - DNA, 487 bp, Homo sapiens; identical to SEQ ID NO: 536272
  misc_feature: HIJSMM301DKFI1.17.25.C03.1.454.light.4.raw

SEQ ID NO: 584475 - DNA, 524 bp, Homo sapiens
  misc_feature: HIJSMM301AW0BF.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcgggcggcgggaccaaagtgaccgtcctaagtcagcccaaggctgccccctcggtccactctcgttcccaccct

SEQ ID NO: 584476 - DNA, 504 bp, Homo sapiens
  misc_feature: HIJSMM301CJX4C.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgccccctcggtcactctgttccaccct

SEQ ID NO: 584477 - DNA, 513 bp, Homo sapiens; identical to SEQ ID NO: 535244
  misc_feature: HIJSMM301BSM3C.17.33.C11.1.454.light.4.raw

SEQ ID NO: 584478 - DNA, 491 bp, Homo sapiens; identical to SEQ ID NO: 536211
  misc_feature: HIJSMM301AL6FX.16.53.E09.1.454.light.4.raw

SEQ ID NO: 584479 - DNA, 486 bp, Homo sapiens; identical to SEQ ID NO: 535043
  misc_feature: HIJSMM301EWA5H.46.35.D02.1.454.light.4.raw

SEQ ID NO: 584480 - DNA, 505 bp, Homo sapiens
  misc_feature: HIJSMM301BEKKM.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggaggaccaagctgaccgtcg

SEQ ID NO: 584481 - DNA, 501 bp, Homo sapiens
  misc_feature: HIJSMM301BRO5Y.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgcccctc

SEQ ID NO: 584482 - DNA, 441 bp, Homo sapiens; identical to SEQ ID NO: 535074
  misc_feature: HIJSMM301EFYS9.11.3.A03.1.454.light.4.raw

SEQ ID NO: 584483 - DNA, 516 bp, Homo sapiens
  misc_feature: HIJSMM301CJEQ9.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagcccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttcccta

SEQ ID NO: 584484 - DNA, 501 bp, Homo sapiens
  misc_feature: HIJSMM301DRJLN.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcgaactgggactaaggtcaccgtcctaggtcagcccaaggccaaccccatgtca

SEQ ID NO: 584485 - DNA, 505 bp, Homo sapiens
  misc_feature: HIJSMM301D4DJW.53.14.B03.1.454.light.4.raw
  modified_base (427)..(427): a, c, t, g, unknown or other
cgcgtatacacacgaccggtgctcgatttagtgtgagtagttccgcgggggggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgacttattactgtcaatctgcggacagcagtggttcncatgtggtattcgggcggagggaccaagctgaccgtcctaggtcacgcccaaggctcgccccctcggtcactctcgtt

SEQ ID NO: 584486 - DNA, 486 bp, Homo sapiens; identical to SEQ ID NO: 535290
  misc_feature: HIJSMM301CWOAD.3.12.B01.1.454.light.4.raw

SEQ ID NO: 584487 - DNA, 486 bp, Homo sapiens
  misc_feature: HIJSMM301AXR4E.13.36.D03.1.454.light.4.raw
tcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgacgtggagattaaaggaa

SEQ ID NO: 584488 - DNA, 516 bp, Homo sapiens; identical to SEQ ID NO: 536108
  misc_feature: HIJSMM301DQ9YV.22.30.C08.1.454.light.4.raw

SEQ ID NO: 584489 - DNA, 509 bp, Homo sapiens; identical to SEQ ID NO: 539359
  misc_feature: HIJSMM301BRKYE.47.85.H08.1.454.light.4.raw

SEQ ID NO: 584490 - DNA, 514 bp, Homo sapiens
  misc_feature: HIJSMM301EWU9U.15.86.H09.1.454.light.4.raw
  modified_base (502)..(502): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccgaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccgccctccncgctacgtagac

SEQ ID NO: 584491 - DNA, 488 bp, Homo sapiens; identical to SEQ ID NO: 537124
  misc_feature: HIJSMM301BEAMJ.11.25.C03.1.454.light.4.raw

SEQ ID NO: 584492 - DNA, 513 bp, Homo sapiens
  misc_feature: HIJSMM301A2ETI.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagcccaaggctgccccctcggtcactctgtt

SEQ ID NO: 584493 - DNA, 493 bp, Homo sapiens
  misc_feature: HIJSMM301BDC09.4.9.A09.1.454.light.4.raw
agcactgtagcacgaccggtgctcgatttagcgagacgcgcagggggaggaactgctcagttaggacccagacggaaccatggaagccccagcgcagcttcttttcctcctgctactctggctcccagataccactggagaaatagtgatgacgcagtctccagccaccctgtctgtgtctccgaggggcaagggccaccctctcctgcagggccagtcagagtgtcagcaacaacttagcctggtaccagcagaaacctggccagcctcccaggctcctcatctatggtacatccaccagggccactggtattccagtcaggtttagtggcagcgggtctgggacagaattcactctcaccatcagcagcctgcagtctgaagtattttgctagtttattactgtcagcagtataataattggcctccttcactttcggcctgggaccaagtggatatacaaacgaactgtggctgcaccatctgtcttcta

SEQ ID NO: 584494 - DNA, 504 bp, Homo sapiens; identical to SEQ ID NO: 550984
  misc_feature: HIJSMM301DULCZ.18.37.D04.1.454.light.4.raw

SEQ ID NO: 584495 - DNA, 506 bp, Homo sapiens; identical to SEQ ID NO: 576101
  misc_feature: HIJSMM301BHSYZ.40.28.C06.1.454.light.4.raw

SEQ ID NO: 584496 - DNA, 515 bp, Homo sapiens
  misc_feature: HIJSMM301C9GYA.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctggtcactctgttcccaccctcctca

SEQ ID NO: 584497 - DNA, 518 bp, Homo sapiens
  misc_feature: HIJSMM301CTG8U.27.23.C01.1.454.light.4.raw
agcgtcgtctcacgaccggtgctcgatttagtacacgtgattagggattggagggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctcgttccca

SEQ ID NO: 584498 - DNA, 500 bp, Homo sapiens
  misc_feature: HIJSMM301BWT1P.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctcggggtccctgacaggttcagtggcagtggatcaggcatagattttacactgaaaatcagcagagtggaggctgaggacgttggggttattactgcatgcaaggtctacaaaccccgatcaccttcggccgtagggacacggcctgggagattaaacgaactgtggctggcaccat

SEQ ID NO: 584499 - DNA, 506 bp, Homo sapiens
  misc_feature: HIJSMM301ELDFG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaagggaccgaaggtaggaaatacaaacgaactgtggctgcaccatctgtcttcatcttccccg

SEQ ID NO: 584500 - DNA, 487 bp, Homo sapiens; identical to SEQ ID NO: 538189
  misc_feature: HIJSMM301A93LY.3.12.B01.1.454.light.4.raw

SEQ ID NO: 584501 - DNA, 511 bp, Homo sapiens
  misc_feature: HIJSMM301BOJEP.14.7.A07.1.454.light.4.raw
cgtctagtaccacgaccggtgctcgatttagcacgtgtcgcagggggccctgaggaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggcatttcggtgttcggcggagggacccaggtgaccgtcctacgtccagcccaagg

SEQ ID NO: 584502 - DNA, 497 bp, Homo sapiens
  misc_feature: HIJSMM301AV41F.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcgccgaaggaccaaggtggaaatcaaacgaactgtggctgcacc

SEQ ID NO: 584503 - DNA, 521 bp, Homo sapiens; identical to SEQ ID NO: 538715
  misc_feature: HIJSMM301DBPK8.27.23.C01.1.454.light.4.raw

SEQ ID NO: 584504 - DNA, 503 bp, Homo sapiens
  misc_feature: HIJSMM301DSVUN.4.37.D04.1.454.light.4.raw
agcactgtagcacgaccggtgctcgatttagtagcatactgttgggtttgggggctttgcctgggctctgctattcctcaccctcctcactcagggcacagggtcctgggcccagtctgccctgactcagcctgcctccgtgtctgggtctcctggacagtcgatcatcgccatctcctgcactggaaccagcagtgacgttggtggttataactatgtctcctggtatcaacagcacccaggcaaagcccccaaactcataatttatgatgtcagtaatcggccctcaggggtttctaatcgcttctctggttacaagtctggcaacacggcctccctgaccatctctgggctccaggctgaggacgaggctgattattactgcagctcatatacaagcagcagcactggggtcttcggaactgggaccaaggtcaccgtcgtcccacgtcagcccaaggccaaccccactgtcactctgttcccgccctcctcctacagtg

SEQ ID NO: 584505 - DNA, 377 bp, Homo sapiens; identical to SEQ ID NO: 536071
  misc_feature: HIJSMM301BICG5.40.9.A09.1.454.light.4.raw

SEQ ID NO: 584506 - DNA, 508 bp, Homo sapiens
  misc_feature: HIJSMM301D2NSC.48.56.F01.1.454.light.4.raw
agtatacatacacgaccggtgctcgatttagcagacgtctgaacacacaaaggggtggtagctcaggaagcagagcctggagcatctccactatggcctggactccactacttctcaccctcctcgctcactgcacaggttcttgggccacttttaaactgactcagccccactccgtgtcggggtctccggggaagacggtaagcatcacctgcacccgcaccagtggcgacattgccagcaactttgtgcagtgggtccagcagcgcccgggccgttcccccgccactgtaatatatgaggacattcaaagaccttctggggtccctcctcgattctctggctccatcgacaggtcctccaactccgcctccctcttcatctctgaactgaagactgaggacgaggctgcttattactgtcagtcctctgatggcagcgcagttgtcttcggcggagggaccacactgaccgttatcggtcagcccaaggctgcccctcggtcact

SEQ ID NO: 584507 - DNA, 516 bp, Homo sapiens; identical to SEQ ID NO: 575815
  misc_feature: HIJSMM301AZSOR.49.11.A11.1.454.light.4.raw

SEQ ID NO: 584508 - DNA, 494 bp, Homo sapiens; identical to SEQ ID NO: 534992
  misc_feature: HIJSMM301ETHBD.9.1.A01.1.454.light.4.raw

SEQ ID NO: 584509 - DNA, 521 bp, Homo sapiens
  misc_feature: HIJSMM301BT78W.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcacttctgttcccacct

SEQ ID NO: 584510 - DNA, 504 bp, Homo sapiens; identical to SEQ ID NO: 557936
  misc_feature: HIJSMM301ASTAE.19.78.H01.1.454.light.4.raw

SEQ ID NO: 584511 - DNA, 492 bp, Homo sapiens
  misc_feature: HIJSMM301B5W6M.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcgaggtacttatgtcttcggaactcgggaccctacgttaccgtcctaggtcagaccccg

SEQ ID NO: 584512 - DNA, 520 bp, Homo sapiens
  misc_feature: HIJSMM301A3FZU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccgaaggaccgaacggtaggaaggtacgaaacgaactacgtggcgtggcaccactctgtcttctactcttcccgtcccact

SEQ ID NO: 584513 - DNA, 497 bp, Homo sapiens
  misc_feature: HIJSMM301D7YAY.3.71.G05.1.454.light.4.raw
  modified_base (439)..(439): a, c, t, g, unknown or other
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggnggagggaccaaggtgaccgtcctacgtcagcccaaggctgccccctcggtcactctcg

SEQ ID NO: 584514 - DNA, 460 bp, Homo sapiens; identical to SEQ ID NO: 537107
  misc_feature: HIJSMM301BMPNW.22.28.C06.1.454.light.4.raw

SEQ ID NO: 584515 - DNA, 515 bp, Homo sapiens
  misc_feature: HIJSMM301C6UK1.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggtcggagggaccgaaggtaggaccgtcaaacaaactagtggctgcaccatctgtcttctatcttcccgtcccat

SEQ ID NO: 584516 - DNA, 492 bp, Homo sapiens
  misc_feature: HIJSMM301DH1ZB.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggcacgactggagattaacgaactgtggctgcaccatctgtctt

SEQ ID NO: 584517 - DNA, 503 bp, Homo sapiens; identical to SEQ ID NO: 547049
  misc_feature: HIJSMM301BPZA9.18.59.F04.1.454.light.4.raw

SEQ ID NO: 584518 - DNA, 495 bp, Homo sapiens; identical to SEQ ID NO: 538651
  misc_feature: HIJSMM301CIOAB.10.79.H02.1.454.light.4.raw

SEQ ID NO: 584519 - DNA, 520 bp, Homo sapiens
  misc_feature: HIJSMM301AL6RL.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttggtgttcggcggagggaccaggctgaccgtcctaggtcagcccaaggctgccccctcggtcactctgttcccaccct

SEQ ID NO: 584520 - DNA, 448 bp, Homo sapiens
  misc_feature: HIJSMM301C6R3V.18.9.A09.1.454.light.4.raw
tacgagtatgcacgaccggtgctcgatttagcgagacgcgcaggggtcctgggcccagtctgtgctgacgcagccgccctcagtgtctggggccccagggcagagggtcaccatctcctgcactgggagcacctccaacatcggggcgggttatgatgtacactggtaccagcagcttccagggacacgcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcacgtcctaagtcagcccaaggccaacccctctgtcactctgttcccgccctcctccatactcgta

SEQ ID NO: 584521 - DNA, 504 bp, Homo sapiens
  misc_feature: HIJSMM301AQXIU.43.57.F02.1.454.light.4.raw
tgtgagtagtcacgaccggtgctcgatttagctcgatatagttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtcccctggacagtcagtcaccatctcctgcactggaagcagcagtgacattggtggttatacatatgtctcctggtaccaacagcacccaggcaaagcccccaaactcatgatttatgagggcactaagcggccctcaggggtttctgatcgcttctctggctccaagtctggcaacacggcctccctgacaatctctgggctccaggctgaggacgaggctgatttattattgctgctcatatgcaggtagttacacttatgtcttcgggaattgggacgacggtcaccgtctaggtcagcccaaggccaacccatgt

SEQ ID NO: 584522 - DNA, 519 bp, Homo sapiens; identical to SEQ ID NO: 582271
  misc_feature: HIJSMM301ARJIM.22.30.C08.1.454.light.4.raw

SEQ ID NO: 584523 - DNA, 485 bp, Homo sapiens; identical to SEQ ID NO: 543180
  misc_feature: HIJSMM301CDMPC.3.10.A10.1.454.light.4.raw

SEQ ID NO: 584524 - DNA, 485 bp, Homo sapiens; identical to SEQ ID NO: 536263
  misc_feature: HIJSMM301EFQMQ.47.78.H01.1.454.light.4.raw

SEQ ID NO: 584525 - DNA, 489 bp, Homo sapiens; identical to SEQ ID NO: 553026
  misc_feature: HIJSMM301BC7YR.5.47.E03.1.454.light.4.raw

SEQ ID NO: 584526 - DNA, 479 bp, Homo sapiens
  misc_feature: HIJSMM301BEHXQ.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccaggctcctcatctatggtgcatccaccagggccactggtatcccagccaggttcagtgccagtgggtctgggacagagttcactctcaccatcagcagcctgcagtctgaagattttgtcggtttattactgtcagcagtatgataactggctgtacacttttggccgaggggaccaagctggagatcaggcgaactgtgg

SEQ ID NO: 584527 - DNA, 491 bp, Homo sapiens; identical to SEQ ID NO: 543478
  misc_feature: HIJSMM301ADF99.14.55.E11.1.454.light.4.raw

SEQ ID NO: 584528 - DNA, 510 bp, Homo sapiens; identical to SEQ ID NO: 535474
  misc_feature: HIJSMM301E305X.17.33.C11.1.454.light.4.raw

SEQ ID NO: 584529 - DNA, 503 bp, Homo sapiens; identical to SEQ ID NO: 558036
  misc_feature: HIJSMM301BHBPS.18.78.H01.1.454.light.4.raw

SEQ ID NO: 584530 - DNA, 497 bp, Homo sapiens
  misc_feature: HIJSMM301CNDRD.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagatttgcagtttattactgtcagcagtataattactggcctcggacgttcggtccgaagggaccgaacggtaggaagtacaaacgaactagtggctgcaccatctgtctt

SEQ ID NO: 584531 - DNA, 502 bp, Homo sapiens; identical to SEQ ID NO: 543936
  misc_feature: HIJSMM301DLYX3.15.1.A01.1.454.light.4.raw

SEQ ID NO: 584532 - DNA, 521 bp, Homo sapiens
  misc_feature: HIJSMM301DS8XP.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctcgttcccaccct

SEQ ID NO: 584533 - DNA, 485 bp, Homo sapiens
  misc_feature: HIJSMM301A6YJN.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagctggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccaggggaccaagctggagatcaggacg

SEQ ID NO: 584534 - DNA, 490 bp, Homo sapiens
  misc_feature: HIJSMM301BQT6I.40.12.B01.1.454.light.4.raw
tctagcgactcacgaccggtgctcgatttagtagtgtagattcggcggggatcaggactcctcagttcaccttctcacaatgaggctccctgctcagctcctggggctgctaatgctctgggtctctggatccagtggggatattgtgatgactcagtctccactctccctgcccgtcactcctggagagccggcctccatctcctgcaggtctagtcagagcctcctaaacactaatggatactactctttgaattggtacctgcagaagccagggcagtctccacagctcttgatatattggggttcttatcgggcctccggggtccctgacaggttcagtggcagtggatcagtcacagattttacactgaaaatcagcagggtggaggcagaagatgttgggatttattactgcatgcaactctacaaactgtgtggacggtcggccaagggaccaaggtgaaatcaagcgaactgtgctgcacca

SEQ ID NO: 584535 - DNA, 444 bp, Homo sapiens; identical to SEQ ID NO: 535192
  misc_feature: HIJSMM301AT66S.5.9.A09.1.454.light.4.raw

SEQ ID NO: 584536 - DNA, 490 bp, Homo sapiens; identical to SEQ ID NO: 535234
  misc_feature: HIJSMM301DKN30.17.21.B10.1.454.light.4.raw

SEQ ID NO: 584537 - DNA, 509 bp, Homo sapiens
  misc_feature: HIJSMM301B93X7.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctgttcccaccctcctcgctacgtagtacgtgacggcggtcgcggacgac

SEQ ID NO: 584538 - DNA, 488 bp, Homo sapiens
  misc_feature: HIJSMM301EQIPJ.41.44.D11.1.454.light.4.raw
tctatactatcacgaccggtgctcgatttagcgcagtacgaagggggctgcgggggtaagaggttgtgtccaccatggcctggactccttctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgtggatgaggctgactactattgcacggtctggtacagcagcgctgtggtcttcggcggagggactgaacttatcgtcctaggtcagcccaa

SEQ ID NO: 584539 - DNA, 487 bp, Homo sapiens
  misc_feature: HIJSMM301DCQX0.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagtaacttttggccgaggggaccaagctggagatcaaacgaactgtgctgcaccat

SEQ ID NO: 584540 - DNA, 492 bp, Homo sapiens; identical to SEQ ID NO: 536010
  misc_feature: HIJSMM301BME3H.10.20.B09.1.454.light.4.raw

SEQ ID NO: 584541 - DNA, 490 bp, Homo sapiens
  misc_feature: HIJSMM301AM49E.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccgaaggtggaagtcaagcgaactgtggctgcaccatctgtt

SEQ ID NO: 584542 - DNA, 493 bp, Homo sapiens
  misc_feature: HIJSMM301BOABE.51.59.F04.1.454.light.4.raw
cgatcgtatacacgaccggtgctcgatttagtacacacacttagggattgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgt

SEQ ID NO: 584543 - DNA, 487 bp, Homo sapiens; identical to SEQ ID NO: 538190
  misc_feature: HIJSMM301BET7W.47.70.G04.1.454.light.4.raw

SEQ ID NO: 584544 - DNA, 523 bp, Homo sapiens
  misc_feature: HIJSMM301BJVPQ.48.24.C02.1.454.light.4.raw
agtatacatacacgaccggtgctcgatttagtacagatcgttagggaaagggggggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagccaaggctgccccctcggtcactctgttcccaccctcctcta

SEQ ID NO: 584545 - DNA, 446 bp, Homo sapiens; identical to SEQ ID NO: 557437
  misc_feature: HIJSMM301A3P66.5.9.A09.1.454.light.4.raw

SEQ ID NO: 584546 - DNA, 433 bp, Homo sapiens
  misc_feature: HIJSMM301AQTCJ.12.67.G01.1.454.light.4.raw
atacgacgtacacgaccggtgctcgatttagagtatacatattgggtttgggggctctgcctgggtgctgttggtaccaggagacatagttataaccaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtcctacgtcagcccaaggccaaccccactgtcactctgttcccgccctcctctacgtcgtat

SEQ ID NO: 584547 - DNA, 499 bp, Homo sapiens; identical to SEQ ID NO: 578318
  misc_feature: HIJSMM301BB9JD.7.5.A05.1.454.light.4.raw

SEQ ID NO: 584548 - DNA, 511 bp, Homo sapiens
  misc_feature: HIJSMM301CRDIO.21.87.H10.1.454.light.4.raw
tcgtcgctcgcacgaccggtgctcgatttagcagtactgcgttgggtttggggggggtcgacaagaggcagcgctctcgggacgtctccaccatggcctgggctctgctgctcctcactctcctcactcagggcacagggtcctgggcccagtctgccctgactcggcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcgggacccagatgactgtcctcagtcagcccaaggctgccccctcggtcta

SEQ ID NO: 584549 - DNA, 516 bp, Homo sapiens
  misc_feature: HIJSMM301ARJOP.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggcctgccccctcggtcactctgttcccaaccctcct

SEQ ID NO: 584550 - DNA, 506 bp, Homo sapiens; identical to SEQ ID NO: 555171
  misc_feature: HIJSMM301EUOPY.5.24.C02.1.454.light.4.raw

SEQ ID NO: 584551 - DNA, 488 bp, Homo sapiens
  misc_feature: HIJSMM301CNB0J.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcagggtacagtgtggccttcgctcgcattcggcggagggaccaaggtggaggatcaacgaa

SEQ ID NO: 584552 - DNA, 486 bp, Homo sapiens; identical to SEQ ID NO: 535385
  misc_feature: HIJSMM301BPCE6.19.71.G05.1.454.light.4.raw

SEQ ID NO: 584553 - DNA, 485 bp, Homo sapiens
  misc_feature: HIJSMM301CQ2G4.48.41.D08.1.454.light.4.raw
agtatacatacacgaccggtgctcgatttagtcacgcgagaaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaa

SEQ ID NO: 584554 - DNA, 501 bp, Homo sapiens
  misc_feature: HIJSMM301DCZPP.15.49.E05.1.454.light.4.raw
  modified_base (469)..(469): a, c, t, g, unknown or other
tctacgtagccacgaccggtgctcgatttagagcgactagcaacacacaaagggggaggaactgctcagttaggacccagacggaaccatggaagccccagcgcagcttctcttcctcctgctactctggctaccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgtcgtccgaggaccgaacggtaggaaagtanaaacgaaactacgtaggcgtgcacactcttcg

SEQ ID NO: 584555 - DNA, 496 bp, Homo sapiens
  misc_feature: HIJSMM301DUWNV.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctcgtggacgttcggccaagggaccaaggagcaaatcaaacgaactgtggctgcaccatctgtcttcatcttcccgccat

SEQ ID NO: 584556 - DNA, 505 bp, Homo sapiens
  misc_feature: HIJSMM301C72F4.48.83.H06.1.454.light.4.raw
agtatacatacacgaccggtgctcgatttagatcacgtgcgtcgcggggctgggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccgaggccttggatgaggctgactatcactgtcaggcgtgggacagcaacactgcgagttttcggcggggggaccgaggctgaccggtcggcggtcagcccaaggctgccccctcggtcactctcgttcccg

SEQ ID NO: 584557 - DNA, 494 bp, Homo sapiens; identical to SEQ ID NO: 576653
  misc_feature: HIJSMM301EMX89.9.19.B08.1.454.light.4.raw

SEQ ID NO: 584558 - DNA, 491 bp, Homo sapiens
  misc_feature: HIJSMM301DCH8X.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagacttggactttattactgtcagcagcgtgagttctggcctccgctcactttcggcggagggaccagggtggagatcaaacgaactgtggctgcacatctgtcttcatt

SEQ ID NO: 584559 - DNA, 488 bp, Homo sapiens
  misc_feature: HIJSMM301BS1CU.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcggccaccagtcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggttggatatcaagacgaa

SEQ ID NO: 584560 - DNA, 504 bp, Homo sapiens; identical to SEQ ID NO: 535561
  misc_feature: HIJSMM301A4M82.4.57.F02.1.454.light.4.raw

SEQ ID NO: 584561 - DNA, 508 bp, Homo sapiens; identical to SEQ ID NO: 554667
  misc_feature: HIJSMM301CPG2B.2.21.B10.1.454.light.4.raw

SEQ ID NO: 584562 - DNA, 505 bp, Homo sapiens
  misc_feature: HIJSMM301ECXY8.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcgaggggtttctaatcgcttctctggctccaagtctggcaacacggcctcctgacaatctctgggctccaggctgaggacgaggctgattactactgctgctcatatgcaggtcgtatctcttatgtcttcggaactgggaccaaggtcaccgtcctaggtcagcccaaggccaacccccatgtcta

SEQ ID NO: 584563 - DNA, 504 bp, Homo sapiens
  misc_feature: HIJSMM301COICN.2.35.D02.1.454.light.4.raw
  modified_base (474)..(474): a, c, t, g, unknown or other
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtccngggtcagcccaaggctgccccctcggtcta

SEQ ID NO: 584564 - DNA, 497 bp, Homo sapiens; identical to SEQ ID NO: 536376
  misc_feature: HIJSMM301AJDT3.22.9.A09.1.454.light.4.raw

SEQ ID NO: 584565 - DNA, 506 bp, Homo sapiens
  misc_feature: HIJSMM301EOMD5.11.75.G09.1.454.light.4.raw
cgagagataccacgaccggtgctcgatttagtatagacatcaggggacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaactcctcatctatgctgacaacaatcgaccttcaggggtccctgaccggttctctggctccaagtctggctcttccgcctccttggccatcactgggctcgaggctgacgatgaggctgattactactgtctgtcctatgacgacgactacagactccggttttcggcggagggactaagctgaccgtcctaagtcagcccaaggctgccccctcggtcactcctgttccca

SEQ ID NO: 584566 - DNA, 403 bp, Homo sapiens
  misc_feature: HIJSMM301AQCUT.12.78.H01.1.454.light.4.raw
atacgacgtacacgaccggtgctcgatttagtgtgagtagtttgggtttggggacccccgggcagagggtcaccatctcttgttctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccaccctcctctacgtctat

SEQ ID NO: 584567 - DNA, 444 bp, Homo sapiens; identical to SEQ ID NO: 535027
  misc_feature: HIJSMM301BKXN5.8.73.G07.1.454.light.4.raw

SEQ ID NO: 584568 - DNA, 496 bp, Homo sapiens
  misc_feature: HIJSMM301CCGHC.10.79.H02.1.454.light.4.raw
catagtagtgcacgaccggtgctcgatttagtgtcacacgaagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtctagcaatatggtaggtcaccttgggacttttggccaggggaccaagctggagatcaaacgaactagtggctgcaccatctgtctt

SEQ ID NO: 584569 - DNA, 496 bp, Homo sapiens
  misc_feature: HIJSMM301ATXU5.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcacggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctagtcagcccaaggctgccccctcggtcactctgttcccaccctcctcgagtgcgtct

SEQ ID NO: 584570 - DNA, 506 bp, Homo sapiens
  misc_feature: HIJSMM301DGI4P.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctgagcctgaagatgttgcagtttattactgtcaacatcgtaccgagtggcctcggggccactttcggccctgggaccgaaggtggagatcaaacgaactgtggctgcaccatctgtcttcta

SEQ ID NO: 584571 - DNA, 496 bp, Homo sapiens; identical to SEQ ID NO: 535423
  misc_feature: HIJSMM301A1AW2.3.33.C11.1.454.light.4.raw

SEQ ID NO: 584572 - DNA, 500 bp, Homo sapiens; identical to SEQ ID NO: 546596
  misc_feature: HIJSMM301BTL7Q.18.59.F04.1.454.light.4.raw

SEQ ID NO: 584573 - DNA, 518 bp, Homo sapiens
  misc_feature: HIJSMM301A23DM.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactaggttttctcggggcgttcggtccgaacgggaccgaacgggtggaaaagtacgaaaacgaactagtggctgcaccatctgtcttctatcttccccg

SEQ ID NO: 584574 - DNA, 520 bp, Homo sapiens; identical to SEQ ID NO: 544672
  misc_feature: HIJSMM301DKRMR.27.23.C01.1.454.light.4.raw

SEQ ID NO: 584575 - DNA, 489 bp, Homo sapiens; identical to SEQ ID NO: 544582
  misc_feature: HIJSMM301DZ6CJ.22.65.F10.1.454.light.4.raw

SEQ ID NO: 584576 - DNA, 395 bp, Homo sapiens; identical to SEQ ID NO: 541840
  misc_feature: HIJSMM301DFEIN.49.87.H10.1.454.light.4.raw

SEQ ID NO: 584577 - DNA, 495 bp, Homo sapiens
  misc_feature: HIJSMM301DNWIR.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaacgggaccaaagtaggacgaatcaagcgaactgtggctgcaccatctgtt

SEQ ID NO: 584578 - DNA, 416 bp, Homo sapiens; identical to SEQ ID NO: 536892
  misc_feature: HIJSMM301ALE7I.16.46.E02.1.454.light.4.raw

SEQ ID NO: 584579 - DNA, 478 bp, Homo sapiens
  misc_feature: HIJSMM301DQZNX.48.53.E09.1.454.light.4.raw
agtatacatacacgaccggtgctcgatttagagagagtgtgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcacataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagcccaac

SEQ ID NO: 584580 - DNA, 504 bp, Homo sapiens
  misc_feature: HIJSMM301EQU2S.40.67.G01.1.454.light.4.raw
tctagcgactcacgaccggtgctcgatttagagtatacatattgggtttggggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcat

SEQ ID NO: 584581 - DNA, 515 bp, Homo sapiens
  misc_feature: HIJSMM301BCBU9.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcgggatgaggccgtatatttttgtcaggtgtgggagactaattttggtcatatgttgttcggcggagggaccaagctgaccgtcctcggtcagcccaaggctgccccctcggtcactctgttcccgccctct

SEQ ID NO: 584582 - DNA, 377 bp, Homo sapiens; identical to SEQ ID NO: 536071
  misc_feature: HIJSMM301CMGAZ.40.9.A09.1.454.light.4.raw

SEQ ID NO: 584583 - DNA, 485 bp, Homo sapiens; identical to SEQ ID NO: 536630
  misc_feature: HIJSMM301BL3GB.13.56.F01.1.454.light.4.raw

SEQ ID NO: 584584 - DNA, 454 bp, Homo sapiens; identical to SEQ ID NO: 534964
  misc_feature: HIJSMM301ECAB6.19.86.H09.1.454.light.4.raw

SEQ ID NO: 584585 - DNA, 515 bp, Homo sapiens
  misc_feature: HIJSMM301DAVJ7.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccaacggaccgaacggtacggaaagtacaagacgaacgtagtaggctgcaccactactgtcttctatcttcccgt

SEQ ID NO: 584586 - DNA, 484 bp, Homo sapiens
  misc_feature: HIJSMM301DGBT9.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatacaaacgagctgtggctgcaccat

SEQ ID NO: 584587 - DNA, 499 bp, Homo sapiens; identical to SEQ ID NO: 571545
  misc_feature: HIJSMM301B7SAG.11.67.G01.1.454.light.4.raw

SEQ ID NO: 584588 - DNA, 512 bp, Homo sapiens
  misc_feature: HIJSMM301B2BN7.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctcgttccccg

SEQ ID NO: 584589 - DNA, 489 bp, Homo sapiens; identical to SEQ ID NO: 541604
  misc_feature: HIJSMM301EH9EF.22.86.H09.1.454.light.4.raw

SEQ ID NO: 584590 - DNA, 519 bp, Homo sapiens
  misc_feature: HIJSMM301CQ2C5.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccacctcct

SEQ ID NO: 584591 - DNA, 495 bp, Homo sapiens
  misc_feature: HIJSMM301BQMJ5.13.10.A10.1.454.light.4.raw
tcacgtactacacgaccggtgctcgatttagcgtcgatctcaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattatactgtgttctttatatgggtagtgccatttctgctgtgttcggaggaggcacccggctgaccgtcctcggtcagcccaaggctgcccc

SEQ ID NO: 584592 - DNA, 506 bp, Homo sapiens
  misc_feature: HIJSMM301DND4L.14.85.H08.1.454.light.4.raw
cgtctagtaccacgaccggtgctcgatttagtatcactcagtcgcggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcggggtccctgatcgcttctctggctccaagtctggcaacacggcctccctgaccgtctctgggctccaggctgacgatgaggctgattattactgcagctcacatgcagtcagtaacaatttcggggttttgcggaggaccaagctgaccgtctaagtcagcccaaggctgccccctcggtcactctcg

SEQ ID NO: 584593 - DNA, 509 bp, Homo sapiens; identical to SEQ ID NO: 571138
  misc_feature: HIJSMM301C1FLX.4.57.F02.1.454.light.4.raw

SEQ ID NO: 584594 - DNA, 448 bp, Homo sapiens; identical to SEQ ID NO: 561199
  misc_feature: HIJSMM301B6I74.18.9.A09.1.454.light.4.raw

SEQ ID NO: 584595 - DNA, 489 bp, Homo sapiens; identical to SEQ ID NO: 535139
  misc_feature: HIJSMM301EIPGL.14.55.E11.1.454.light.4.raw

SEQ ID NO: 584596 - DNA, 516 bp, Homo sapiens
  misc_feature: HIJSMM301BM955.48.81.H04.1.454.light.4.raw
agtatacatacacgaccggtgctcgatttagtagtgtagattcgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaaagtaaaaatggaaacatttacttacatttggtttcaacagaggccaggccagtctccaaggcgcctgatttatgacgtttttaaacgggagtctggggtcccagacagattcagcggcaggtgggtcagacactgacttcacactgagaatcagcagggttgaggctgaggatgttggcacttattactgcatgcaaggctcacactggcctccgtggacgttcggccgaagggacccgggtaggaaagtaaacgaactagtggctggcaccatctgtcttcatt

SEQ ID NO: 584597 - DNA, 511 bp, Homo sapiens
  misc_feature: HIJSMM301AEZBD.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccccg

SEQ ID NO: 584598 - DNA, 500 bp, Homo sapiens; identical to SEQ ID NO: 546095
  misc_feature: HIJSMM301EPD20.52.78.H01.1.454.light.4.raw

SEQ ID NO: 584599 - DNA, 488 bp, Homo sapiens; identical to SEQ ID NO: 581537
  misc_feature: HIJSMM301DGMYU.12.88.H11.1.454.light.4.raw

SEQ ID NO: 584600 - DNA, 496 bp, Homo sapiens; identical to SEQ ID NO: 535109
  misc_feature: HIJSMM301BCRFK.16.78.H01.1.454.light.4.raw

SEQ ID NO: 584601 - DNA, 489 bp, Homo sapiens
  misc_feature: HIJSMM301DEMP8.41.72.G06.1.454.light.4.raw
tctatactatcacgaccggtgctcgatttagctacgactgcaagggaaaggggtccaaacagagcttcagcaagcatagtgggaatctgcaccatgccctgggctctgctcctcctgaccctcctcactcactctgcagtgtcagtggtccaggcagggctgactcagccaacctcggtgtccgaggggttgggacagaccgccacactcacctgcactgggaacaacaacaatgttggcgaccaaggagcaacttggctgcagcagcaccagggccaccctcccaaactcctatcctacaggaataacaaccggccctcagggatctcagagagattctctgcatccaggtcaggaaacacagcctccctgaccattactggactccagcctgaggacgaggctgactattactgctcagcatggacagcagcctcacaaattggatgttcggcggagggaccaagctgaccgtctaggtcagcccaa

SEQ ID NO: 584602 - DNA, 467 bp, Homo sapiens; identical to SEQ ID NO: 535997
  misc_feature: HIJSMM301CGCUV.5.36.D03.1.454.light.4.raw

SEQ ID NO: 584603 - DNA, 501 bp, Homo sapiens; identical to SEQ ID NO: 550407
  misc_feature: HIJSMM301BJVV5.4.39.D06.1.454.light.4.raw

SEQ ID NO: 584604 - DNA, 502 bp, Homo sapiens; identical to SEQ ID NO: 536253
  misc_feature: HIJSMM301DJRWO.21.22.B11.1.454.light.4.raw

SEQ ID NO: 584605 - DNA, 490 bp, Homo sapiens
  misc_feature: HIJSMM301C6CBZ.10.72.G06.1.454.light.4.raw
catagtagtgcacgaccggtgctcgatttagctacgactgcaagggaaagggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctccaagtctggcaacacggcttccctgaccatctccgggctccacgcctgaggacgaggctcattattactgcagctcatatacacccaggggcactctcgtgatattcggcggagggacctggctgaccgtcctacgtcagcccaa

SEQ ID NO: 584606 - DNA, 464 bp, Homo sapiens
  misc_feature: HIJSMM301EP5R5.11.12.B01.1.454.light.4.raw
cgagagataccacgaccggtgctcgatttagtagtgtagattccgcggggctgggcctcaggaagcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacagcagcactgcccgttatgtcttcggaactgggaccaaggtcaccgt

SEQ ID NO: 584607 - DNA, 492 bp, Homo sapiens
  misc_feature: HIJSMM301DODBD.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacgatacacttttggccaggggaccaagctggagatcaaacgaactgtggctgcaccat

SEQ ID NO: 584608 - DNA, 501 bp, Homo sapiens; identical to SEQ ID NO: 536818
  misc_feature: HIJSMM301DTIR6.12.82.H05.1.454.light.4.raw

SEQ ID NO: 584609 - DNA, 496 bp, Homo sapiens
  misc_feature: HIJSMM301DHMWO.40.22.B11.1.454.light.4.raw
tctagcgactcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgtggggtttattactgcatgcaagctctacaaattcctcggacgttcggccaagggaccgaacggtggaaagtcaaaacgaactagtggctgcaccaat

SEQ ID NO: 584610 - DNA, 475 bp, Homo sapiens
  misc_feature: HIJSMM301AXQ76.13.4.A04.1.454.light.4.raw
tcacgtactacacgaccggtgctcgatttagagtagtgatcagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagtattttactttcaccatcagcagcctgcagcctgaagatattgcaacatattactgtcagcagtatgataatctcccgatcaccttcggccaaggacacgactggagattaaacgaactgtggctgcacc

SEQ ID NO: 584611 - DNA, 493 bp, Homo sapiens; identical to SEQ ID NO: 535084
  misc_feature: HIJSMM301CGH7N.47.64.F09.1.454.light.4.raw

SEQ ID NO: 584612 - DNA, 486 bp, Homo sapiens; identical to SEQ ID NO: 535917
  misc_feature: HIJSMM301C1TDZ.3.10.A10.1.454.light.4.raw

SEQ ID NO: 584613 - DNA, 522 bp, Homo sapiens; identical to SEQ ID NO: 538091
  misc_feature: HIJSMM301ER2LT.27.23.C01.1.454.light.4.raw

SEQ ID NO: 584614 - DNA, 524 bp, Homo sapiens
  misc_feature: HIJSMM301DNI1H.53.77.G11.1.454.light.4.raw
cgcgtatacacacgaccggtgctcgatttagctagtcactcaagggaaaggggctgggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccgccctcctctcg

SEQ ID NO: 584615 - DNA, 504 bp, Homo sapiens
  misc_feature: HIJSMM301ASHKC.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacggggacgcaacatgggatgacaatctgagcggttgggtgttcggacggagggaccaaactgaccgtcctaggtcagcccaa

SEQ ID NO: 584616 - DNA, 495 bp, Homo sapiens; identical to SEQ ID NO: 535486
  misc_feature: HIJSMM301BGRMV.26.72.G06.1.454.light.4.raw

SEQ ID NO: 584617 - DNA, 504 bp, Homo sapiens
  misc_feature: HIJSMM301DBVZJ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccgacaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaatcaaacgaactagtggctgcaccatctgtcttcatcttccccg

SEQ ID NO: 584618 - DNA, 483 bp, Homo sapiens; identical to SEQ ID NO: 575196
  misc_feature: HIJSMM301C5VVA.41.34.D01.1.454.light.4.raw

SEQ ID NO: 584619 - DNA, 505 bp, Homo sapiens
  misc_feature: HIJSMM301DENXM.48.16.B05.1.454.light.4.raw
agtatacatacacgaccggtgctcgatttagagctcacgtaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctagacaatcgattaccatctcctgcactggaaccagcagtgatattgggagtcataaccttgtctcctggtatcaacaatatccaggcagagccccccaactcataatttatgcggcctctcagcggcccccaggggtttccagtcgcttctctgcctccaagtctggcaacacggcctccttgacaatctctggcctccagcctgaggacgaggctgactattactgctgctcatatacaactatgaatgcttttttgttcggtcggagggaccaaactgaccgtcctcggtcggcccaaggctgccccctcggtcactctcg

SEQ ID NO: 584620 - DNA, 479 bp, Homo sapiens; identical to SEQ ID NO: 553368
  misc_feature: HIJSMM301BVROU.7.76.G10.1.454.light.4.raw

SEQ ID NO: 584621 - DNA, 480 bp, Homo sapiens; identical to SEQ ID NO: 553480
  misc_feature: HIJSMM301DL2G1.21.25.C03.1.454.light.4.raw

SEQ ID NO: 584622 - DNA, 485 bp, Homo sapiens; identical to SEQ ID NO: 535606
  misc_feature: HIJSMM301DRSHF.47.46.E02.1.454.light.4.raw

SEQ ID NO: 584623 - DNA, 500 bp, Homo sapiens
  misc_feature: HIJSMM301BMQW1.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacatggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctcgttcccgccctcctccacgagagta

SEQ ID NO: 584624 - DNA, 506 bp, Homo sapiens
  misc_feature: HIJSMM301CUI7E.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactccccgtggtattcggcggagggaccaaggtgaccgtcctaggtcagcccaaggctcgccccccg

SEQ ID NO: 584625 - DNA, 492 bp, Homo sapiens; identical to SEQ ID NO: 534967
  misc_feature: HIJSMM301EWM00.47.64.F09.1.454.light.4.raw

SEQ ID NO: 584626 - DNA, 521 bp, Homo sapiens; identical to SEQ ID NO: 539470
  misc_feature: HIJSMM301AOS0X.27.23.C01.1.454.light.4.raw

SEQ ID NO: 584627 - DNA, 494 bp, Homo sapiens
  misc_feature: HIJSMM301EVSQE.43.29.C07.1.454.light.4.raw
tgtgagtagtcacgaccggtgctcgatttagagtgctacgaagggaaagggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcggaggagggaccagggtggagatcaaacgaactagtggctgcaccatctgtcttcta

SEQ ID NO: 584628 - DNA, 492 bp, Homo sapiens
  misc_feature: HIJSMM301CHK12.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtggcctaagtaacatcgtcttcggaactggaccaaggtcaccgtccg

SEQ ID NO: 584629 - DNA, 485 bp, Homo sapiens
  misc_feature: HIJSMM301A5AF3.12.8.A08.1.454.light.4.raw
atacgacgtacacgaccggtgctcgatttagcatactctacaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccagcatcacctgctctggagatgtattgactaatgagtatgcttcctggtatcagcagaaggcaggccagccccctgtcctactcatctttcaaataccaggcggccctctggggtccctgagcgattctctggctccgactctgggaacacagtcactctgaccatcagcgggacccaggctattgatgaggctgtctactactgtcaggcgtgggacagcagcgtggtgttcggcggagggaccagtctgaccgtcttaggtcagcccaaggctgccccctcggtctacc

SEQ ID NO: 584630 - DNA, 487 bp, Homo sapiens; identical to SEQ ID NO: 535863
  misc_feature: HIJSMM301EJENV.19.71.G05.1.454.light.4.raw

SEQ ID NO: 584631 - DNA, 492 bp, Homo sapiens; identical to SEQ ID NO: 536010
  misc_feature: HIJSMM301ATBPF.10.20.B09.1.454.light.4.raw

SEQ ID NO: 584632 - DNA, 473 bp, Homo sapiens; identical to SEQ ID NO: 558291
  misc_feature: HIJSMM301EDOSQ.52.59.F04.1.454.light.4.raw

SEQ ID NO: 584633 - DNA, 503 bp, Homo sapiens
  misc_feature: HIJSMM301DNDVV.43.38.D05.1.454.light.4.raw
tgtgagtagtcacgaccggtgctcgatttagtatctgatagttgggtttgggggagtcagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaaatcaaacgaactagtggctgcaccatctgtcttcatcttccccg

SEQ ID NO: 584634 - DNA, 502 bp, Homo sapiens; identical to SEQ ID NO: 543936
  misc_feature: HIJSMM301DS34M.15.1.A01.1.454.light.4.raw

SEQ ID NO: 584635 - DNA, 506 bp, Homo sapiens
  misc_feature: HIJSMM301ET9L1.8.28.C06.1.454.light.4.raw
ctcgcgtgtccacgaccggtgctcgatttagagctcacgtattgggtttgggggaggaactgctcagttaggacccagacggaaccatggaagccccagcgaagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaacgaactgtggctgcaccatctgtcttcatcttcccgccat

SEQ ID NO: 584636 - DNA, 504 bp, Homo sapiens
  misc_feature: HIJSMM301DQ46L.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctcgcccctcgg

SEQ ID NO: 584637 - DNA, 511 bp, Homo sapiens; identical to SEQ ID NO: 548439
  misc_feature: HIJSMM301CLMGF.16.46.E02.1.454.light.4.raw

SEQ ID NO: 584638 - DNA, 512 bp, Homo sapiens
  misc_feature: HIJSMM301AZMY4.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggccccctcatctatggtgcagtccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaacggtggagatcaaacgaactgtggctgcaccatctcgtcttcta

SEQ ID NO: 584639 - DNA, 512 bp, Homo sapiens; identical to SEQ ID NO: 535484
  misc_feature: HIJSMM301CDT9K.8.23.C01.1.454.light.4.raw

SEQ ID NO: 584640 - DNA, 519 bp, Homo sapiens
  misc_feature: HIJSMM301BR072.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcacgtctgttcccaccctcctccacg

SEQ ID NO: 584641 - DNA, 495 bp, Homo sapiens
  misc_feature: HIJSMM301EYYPL.40.65.F10.1.454.light.4.raw
tctagcgactcacgaccggtgctcgatttagctacgctctaaggggagagctgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtcttagcaactacttagtctggtaccaacagaaacctggccaggctcccaggctcctcatctatgatgcatccagcagggccactggcatcccagccaggttcagtggcagtgggtctgggacagacttcactctcaccatcagcggcctagagcctgaagactttgcagtttattactgtcagcagcgtaccaactggccgctcactttcggcggagggaccaaggtggagatcaaacgaactgtggctgcaccatctgtcttcatcttccccg

SEQ ID NO: 584642 - DNA, 503 bp, Homo sapiens
  misc_feature: HIJSMM301ATEAP.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgccatcacgggacgcaacatgggatgacaatctgagcggttgggtgttcggcggagggaccaaactgaccgtcctaggtcagcccaa

SEQ ID NO: 584643 - DNA, 516 bp, Homo sapiens; identical to SEQ ID NO: 542577
  misc_feature: HIJSMM301BCUAL.14.66.F11.1.454.light.4.raw

SEQ ID NO: 584644 - DNA, 484 bp, Homo sapiens
  misc_feature: HIJSMM301EQA4I.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctagagcctgaagattttgcagtttattactgtcagcagcgtagcaactggcctctcactttcggcggagggaccaaggtggagatcaaacgaactgtggctgcacc

SEQ ID NO: 584645 - DNA, 484 bp, Homo sapiens; identical to SEQ ID NO: 535400
  misc_feature: HIJSMM301D5UU0.46.26.C04.1.454.light.4.raw

SEQ ID NO: 584646 - DNA, 478 bp, Homo sapiens; identical to SEQ ID NO: 545991
  misc_feature: HIJSMM301ADIA5.11.11.A11.1.454.light.4.raw

SEQ ID NO: 584647 - DNA, 487 bp, Homo sapiens
  misc_feature: HIJSMM301CMNJ7.3.82.H05.1.454.light.4.raw
agacgcactccacgaccggtgctcgatttagtcgagctctctcgcgggggcaggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgcggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgttcaacaggctgacagtctcccgcctcacttcgtcggagggacggaacggtagggaggagactaacgaaactaacgtggt

SEQ ID NO: 584648 - DNA, 481 bp, Homo sapiens
  misc_feature: HIJSMM301AIR9M.16.86.H09.1.454.light.4.raw
tgtactactccacgaccggtgctcgatttagtgctatagacttgggtttgggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctggattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 584649 - DNA, 489 bp, Homo sapiens; identical to SEQ ID NO: 535139
  misc_feature: HIJSMM301BVT64.14.55.E11.1.454.light.4.raw

SEQ ID NO: 584650 - DNA, 504 bp, Homo sapiens; identical to SEQ ID NO: 535077
  misc_feature: HIJSMM301A1ENR.8.28.C06.1.454.light.4.raw

SEQ ID NO: 584651 - DNA, 514 bp, Homo sapiens
  misc_feature: HIJSMM301CW4EO.14.78.H01.1.454.light.4.raw
cgtctagtaccacgaccggtgctcgatttagtgtgagtagtttgggtttggggggggtcacaagaggcagcgctcttcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctcggtcactctgtt

SEQ ID NO: 584652 - DNA, 502 bp, Homo sapiens
  misc_feature: HIJSMM301B33RN.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaatgaccgtcctaggtcagcccaaggctgccccctc

SEQ ID NO: 584653 - DNA, 505 bp, Homo sapiens; identical to SEQ ID NO: 535503
  misc_feature: HIJSMM301EQYXW.8.28.C06.1.454.light.4.raw

SEQ ID NO: 584654 - DNA, 463 bp, Homo sapiens; identical to SEQ ID NO: 535062
  misc_feature: HIJSMM301ADZ5B.11.73.G07.1.454.light.4.raw

SEQ ID NO: 584655 - DNA, 495 bp, Homo sapiens; identical to SEQ ID NO: 535596
  misc_feature: HIJSMM301DFTGC.10.79.H02.1.454.light.4.raw

SEQ ID NO: 584656 - DNA, 471 bp, Homo sapiens
  misc_feature: HIJSMM301CYP9Q.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaacagggacagcccctaagctcctaatctacgatgcgtctcatttgcagacaggggtcccaccaaggttcagcggaagtggatctgggacagattttaatttcaccatcagcagcctcaacgtgatgatgttgcaacatactattgtcagcaatatgattttgctctccgagtgccacttttggcggggggaccaaggtggacatcaaacgaact

SEQ ID NO: 584657 - DNA, 485 bp, Homo sapiens; identical to SEQ ID NO: 535822
  misc_feature: HIJSMM301APG6Z.14.53.E09.1.454.light.4.raw

SEQ ID NO: 584658 - DNA, 481 bp, Homo sapiens
  misc_feature: HIJSMM301CJZ8J.43.87.H10.1.454.light.4.raw
tgtgagtagtcacgaccggtgctcgatttagcagtactgcgttgggtttggggtccaaacagagcttcagcaagcatagtgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctac

SEQ ID NO: 584659 - DNA, 517 bp, Homo sapiens
  misc_feature: HIJSMM301A59FJ.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataaatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaaggctgaccgtcctaagtcagcccaaggctgccccctcggtcactctgttcccgccctcctcg

SEQ ID NO: 584660 - DNA, 504 bp, Homo sapiens; identical to SEQ ID NO: 549905
  misc_feature: HIJSMM301CA68Y.48.71.G05.1.454.light.4.raw

SEQ ID NO: 584661 - DNA, 522 bp, Homo sapiens; identical to SEQ ID NO: 554788
  misc_feature: HIJSMM301DIU8L.27.23.C01.1.454.light.4.raw
  modified_base (518)..(518): a, c, t, g, unknown or other

SEQ ID NO: 584662 - DNA, 495 bp, Homo sapiens
  misc_feature: HIJSMM301B9V7L.11.81.H04.1.454.light.4.raw
  modified_base (404)..(404): a, c, t, g, unknown or other
  modified_base (474)..(474): a, c, t, g, unknown or other
cgagagataccacgaccggtgctcgatttagtagtgtagattcgcggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgctagttttttacngtcagcagtatagtaactggcctccgtacacttttggccaggggaccaagctagaaatcaaacgaactgnggctgcaccatctgtcttcta

SEQ ID NO: 584663 - DNA, 509 bp, Homo sapiens
  misc_feature: HIJSMM301A6AGC.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgtaccgtccctaggtcgagcccaaggctcgccccctccggtcactcttccg

SEQ ID NO: 584664 - DNA, 508 bp, Homo sapiens; identical to SEQ ID NO: 552440
  misc_feature: HIJSMM301CI5R0.5.24.C02.1.454.light.4.raw

SEQ ID NO: 584665 - DNA, 497 bp, Homo sapiens
  misc_feature: HIJSMM301B2Z9J.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccgaaggggaaagagccaccctctcctgcagggccagtcagagtgttggcagctacttagcctggtaccaacagaaacctggccaggctcccaggctcctcatctatgatgcatccaaacagggccactggcatcccagccaggttcagtggcagtgagtctgggacagacttcactctcaccatcagcagcctagagcctgaagattttgcactttatactgtcagcagcgtagcaactggcctctcactttcggcggagggaccgagggtggaggatcagaacgaactgtggctggcaccatctgtt

SEQ ID NO: 584666 - DNA, 486 bp, Homo sapiens
  misc_feature: HIJSMM301A0H8W.3.10.A10.1.454.light.4.raw
  modified_base (433)..(433): a, c, t, g, unknown or other
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatntcttcgatcgtggacgaggtcaccgtctagtcacgacccaacggacccaaccc

SEQ ID NO: 584667 - DNA, 502 bp, Homo sapiens; identical to SEQ ID NO: 537816
  misc_feature: HIJSMM301CVH4R.19.78.H01.1.454.light.4.raw

SEQ ID NO: 584668 - DNA, 488 bp, Homo sapiens; identical to SEQ ID NO: 537260
  misc_feature: HIJSMM301ETO0O.47.70.G04.1.454.light.4.raw

SEQ ID NO: 584669 - DNA, 486 bp, Homo sapiens; identical to SEQ ID NO: 535043
  misc_feature: HIJSMM301BGHJ5.46.35.D02.1.454.light.4.raw

SEQ ID NO: 584670 - DNA, 507 bp, Homo sapiens
  misc_feature: HIJSMM301ALK2O.19.78.H01.1.454.light.4.raw
tactctcgtgcacgaccggtgctcgatttagtgtgagtagtttgggtttgggggggtcgacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtca

SEQ ID NO: 584671 - DNA, 504 bp, Homo sapiens; identical to SEQ ID NO: 538940
  misc_feature: HIJSMM301EMZ0Z.2.35.D02.1.454.light.4.raw

SEQ ID NO: 584672 - DNA, 500 bp, Homo sapiens
  misc_feature: HIJSMM301C6LNJ.15.56.F01.1.454.light.4.raw
tctacgtagccacgaccggtgctcgatttagcagacgtctgtcgggacgtctccaccatggcctgggctctgctgctcctcactctcctcactcaggacaccgggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgcccctcggtcactctgttcccgccctcctcgctacgtaga

SEQ ID NO: 584673 - DNA, 502 bp, Homo sapiens
  misc_feature: HIJSMM301AGYMW.19.10.A10.1.454.light.4.raw
tactctcgtgcacgaccggtgctcgatttagcgtcgatctcagggggagctgctcagttaggacccagagggaaccatggaaaccccagcgcagcttctcttcctcctgctactctggctcccagatagcaccggagaaattttcttgacgcagtctccaggcaccctgtctttgacccctggggaaagagccaccctctcctgcagggccgataagagtgttgacagcaccttctttgcctggtaccagcagagacctggccaggctcccaggctcctcgtttatggtgcgtccaccagggccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcacatctgtcttcatcttccccg

SEQ ID NO: 584674 - DNA, 505 bp, Homo sapiens; identical to SEQ ID NO: 555744
  misc_feature: HIJSMM301A92B7.7.71.G05.1.454.light.4.raw

SEQ ID NO: 584675 - DNA, 504 bp, Homo sapiens; identical to SEQ ID NO: 535495
  misc_feature: HIJSMM301EIFS4.14.86.H09.1.454.light.4.raw

SEQ ID NO: 584676 - DNA, 487 bp, Homo sapiens
  misc_feature: HIJSMM301A5QF9.19.71.G05.1.454.light.4.raw
  modified_base (440)..(440): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattanacttcgtggacgttcggtccaagggaccaaggtggatatcagacgaa

SEQ ID NO: 584677 - DNA, 498 bp, Homo sapiens
  misc_feature: HIJSMM301CPIQ6.4.59.F04.1.454.light.4.raw
agcactgtagcacgaccggtgctcgatttagtacacacacttagggattgggggaggaactgctcagttaggacccagacggaaccatggaagccccagcgcagcttctcttcctcctgctactctggctcccagataccactggagaaataatattgacgcagtctccagccaccctgtctgtgtctccaggggaaagagccaccctctcctgcagggccagtcagagtgttagcagcaacttagcctggtaccagcagaagcctggccagactcccaggctcctcatctttggtgcattcaccagggccactgatatcccaaccaggttcagcggcagtgggtctgggacagagttcactctcaccatcagcaacctgcagtctgaagattctgcagtttattattgtcaccagtatttatagttggcctccgtggacgttcggtccaagggaccgaaggtggaatcaaacgaactgtggctgcaccatctgtctt

SEQ ID NO: 584678 - DNA, 517 bp, Homo sapiens
  misc_feature: HIJSMM301BWX1S.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgaacggaccgaacggtaggaagtacgaaacgaactagtggcgtgcaccactctcgtcttctactcttcccgtccact

SEQ ID NO: 584679 - DNA, 495 bp, Homo sapiens
  misc_feature: HIJSMM301AD6DN.43.34.D01.1.454.light.4.raw
tgtgagtagtcacgaccggtgctcgatttagatcgtctgtgttgggtttgggggctggggtcacaagaggcagcgctctcgggacgtctccaccatggcctgggctctgctgctcctcactctcctcgctcaggacacagggtcctgggcccagtcctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaagg

SEQ ID NO: 584680 - DNA, 517 bp, Homo sapiens; identical to SEQ ID NO: 541955
  misc_feature: HIJSMM301AP8KN.22.30.C08.1.454.light.4.raw

SEQ ID NO: 584681 - DNA, 476 bp, Homo sapiens; identical to SEQ ID NO: 538026
  misc_feature: HIJSMM301CRL9W.13.76.G10.1.454.light.4.raw

SEQ ID NO: 584682 - DNA, 520 bp, Homo sapiens; identical to SEQ ID NO: 571890
  misc_feature: HIJSMM301B19CT.27.23.C01.1.454.light.4.raw

SEQ ID NO: 584683 - DNA, 502 bp, Homo sapiens; identical to SEQ ID NO: 557696
  misc_feature: HIJSMM301DO8HI.22.15.B04.1.454.light.4.raw

SEQ ID NO: 584684 - DNA, 495 bp, Homo sapiens; identical to SEQ ID NO: 576096
  misc_feature: HIJSMM301CZ9UT.10.25.C03.1.454.light.4.raw

SEQ ID NO: 584685 - DNA, 494 bp, Homo sapiens; identical to SEQ ID NO: 535680
  misc_feature: HIJSMM301E0140.16.78.H01.1.454.light.4.raw

SEQ ID NO: 584686 - DNA, 386 bp, Homo sapiens
  misc_feature: HIJSMM301A27MD.10.38.D05.1.454.light.4.raw
catagtagtgcacgaccggtgctcgatttagtatctgatagttgggtttgggggctttgcctgggtggtactggaaccagcagtgactttgttgcttataactatgtctcctggtaccagcaccacccaggcaaagcccccaaactccttgttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccctcctccactactatg

SEQ ID NO: 584687 - DNA, 503 bp, Homo sapiens; identical to SEQ ID NO: 582350
  misc_feature: HIJSMM301AITZC.18.26.C04.1.454.light.4.raw

SEQ ID NO: 584688 - DNA, 496 bp, Homo sapiens
  misc_feature: HIJSMM301BD3FF.19.83.H06.1.454.light.4.raw
tactctcgtgcacgaccggtgctcgatttagatcacgtgcgtcgcgggcgtagactttgtgtttctcgtagtctgctttgctcagcgtcagggtgctgctaatgctctgggtctctggatccagtggggatattgtggtgactcagtctccactctccctgcccgtcattcctggagagccggcctccatctcctgcaagtctagtcagagcctcctacatagtaatggacacaactatttggattggtacctgcagaagccagggcagtctccacagctcctgatctatttgggttctaatcgggcctccggggtccctgacaggttcagtggcagtggatcaggcacagattttacactgaaaatcaacagagtggaggctgaggatgttggggtttattacttgcatgcaagctctacaaactccctacaacgttcggcggagggaccaaggtggagatacaaacgaactgtggctgcaccatctgtcttcta

SEQ ID NO: 584689 - DNA, 488 bp, Homo sapiens; identical to SEQ ID NO: 576432
  misc_feature: HIJSMM301ELDBO.4.33.C11.1.454.light.4.raw

SEQ ID NO: 584690 - DNA, 482 bp, Homo sapiens
  misc_feature: HIJSMM301CH65N.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtgggtcccatcaagattcagtggcagtggatctgggacagatttcactctcaccatcagtagtctacaacctgaagattttgcaacttactactgtcaacagagttacgatacccctccgctcactttcggcggagggaccaaggtggagatcaaacgactgtggctgcac

SEQ ID NO: 584691 - DNA, 480 bp, Homo sapiens
  misc_feature: HIJSMM301BFXAE.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgtaacttactattgtcaacaggctaacagtttcccgctcaccttcggcgggggaccaaggtggagatcaaacgaactgtggctgcaccat

SEQ ID NO: 584692 - DNA, 489 bp, Homo sapiens; identical to SEQ ID NO: 558034
  misc_feature: HIJSMM301BUMR8.8.12.B01.1.454.light.4.raw

SEQ ID NO: 584693 - DNA, 487 bp, Homo sapiens; identical to SEQ ID NO: 536206
  misc_feature: HIJSMM301ER37M.47.38.D05.1.454.light.4.raw

SEQ ID NO: 584694 - DNA, 504 bp, Homo sapiens; identical to SEQ ID NO: 542411
  misc_feature: HIJSMM301B7WW0.9.53.E09.1.454.light.4.raw

SEQ ID NO: 584695 - DNA, 495 bp, Homo sapiens; identical to SEQ ID NO: 576393
  misc_feature: HIJSMM301BHQ0Q.11.81.H04.1.454.light.4.raw

SEQ ID NO: 584696 - DNA, 494 bp, Homo sapiens; identical to SEQ ID NO: 534994
  misc_feature: HIJSMM301CTW91.27.78.H01.1.454.light.4.raw

SEQ ID NO: 584697 - DNA, 496 bp, Homo sapiens
  misc_feature: HIJSMM301APM3X.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctgatgattttgcaacttattactgtcaacagtataatagtaattcctggacgttcggtccaagggaccgaaggtaggaaagtacaaacgaaactagtggcgtgcaccatctgtctt

SEQ ID NO: 584698 - DNA, 505 bp, Homo sapiens
  misc_feature: HIJSMM301BOO8G.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactagtggctgcaccatctgtcttctatt

SEQ ID NO: 584699 - DNA, 495 bp, Homo sapiens; identical to SEQ ID NO: 539288
  misc_feature: HIJSMM301BNT1E.9.1.A01.1.454.light.4.raw

SEQ ID NO: 584700 - DNA, 489 bp, Homo sapiens; identical to SEQ ID NO: 536663
  misc_feature: HIJSMM301DF1J5.16.72.G06.1.454.light.4.raw

SEQ ID NO: 584701 - DNA, 486 bp, Homo sapiens; identical to SEQ ID NO: 536329
  misc_feature: HIJSMM301BPKAP.21.4.A04.1.454.light.4.raw

SEQ ID NO: 584702 - DNA, 498 bp, Homo sapiens; identical to SEQ ID NO: 544540
  misc_feature: HIJSMM301B5SW8.41.20.B09.1.454.light.4.raw

SEQ ID NO: 584703 - DNA, 492 bp, Homo sapiens; identical to SEQ ID NO: 557796
  misc_feature: HIJSMM301D3JPT.49.66.F11.1.454.light.4.raw

SEQ ID NO: 584704 - DNA, 495 bp, Homo sapiens
  misc_feature: HIJSMM301C2CPH.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggtattttgcagtgtattactgtcagcagtatcataggtcaaacaccttcggccaagggacacgactggagattaaaggaactgtggctgcaccatctgtcttcatcttccccg

SEQ ID NO: 584705 - DNA, 500 bp, Homo sapiens
  misc_feature: HIJSMM301CDDMG.15.1.A01.1.454.light.4.raw
  modified_base (409)..(409): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattacngctgctcatatgaaggttataacactatactattcggcggagggaccaagctgaccgtcctgcgtcagcccaaggctgccccctggtcact

SEQ ID NO: 584706 - DNA, 485 bp, Homo sapiens; identical to SEQ ID NO: 536040
  misc_feature: HIJSMM301ESHPS.15.1.A01.1.454.light.4.raw

SEQ ID NO: 584707 - DNA, 512 bp, Homo sapiens
  misc_feature: HIJSMM301BGK1F.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtgttcggcgggggaccgacactgaccgtcctaggtcagccaaggctgccccctcggtcactctgtt

SEQ ID NO: 584708 - DNA, 485 bp, Homo sapiens
  misc_feature: HIJSMM301D8ZW0.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttatactgtcagcagtattgtgaagcctccgctctacgtttcggcggagggaccgcgggtggagatccagacgaactggtggctgccaccatctgtctt

SEQ ID NO: 584709 - DNA, 515 bp, Homo sapiens
  misc_feature: HIJSMM301D0TK3.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaaggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccgccctctcacg

SEQ ID NO: 584710 - DNA, 483 bp, Homo sapiens
  misc_feature: HIJSMM301DI3B6.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacaatctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagatcagacgaa

SEQ ID NO: 584711 - DNA, 485 bp, Homo sapiens
  misc_feature: HIJSMM301BO86L.52.5.A05.1.454.light.4.raw
cgcagtacgacacgaccggtgctcgatttagatagatagacagggggggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctcggtcta

SEQ ID NO: 584712 - DNA, 493 bp, Homo sapiens; identical to SEQ ID NO: 537422
  misc_feature: HIJSMM301BN9X6.9.34.D01.1.454.light.4.raw

SEQ ID NO: 584713 - DNA, 519 bp, Homo sapiens
  misc_feature: HIJSMM301CDGOG.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaacgggaaccgaaggtagggaaatacaaaacgaaacctagtggtctgcaccatctgttcttctacttcttcccccg

SEQ ID NO: 584714 - DNA, 471 bp, Homo sapiens; identical to SEQ ID NO: 537461
  misc_feature: HIJSMM301BR7BS.7.81.H04.1.454.light.4.raw

SEQ ID NO: 584715 - DNA, 507 bp, Homo sapiens; identical to SEQ ID NO: 535641
  misc_feature: HIJSMM301A381G.10.88.H11.1.454.light.4.raw

SEQ ID NO: 584716 - DNA, 499 bp, Homo sapiens; identical to SEQ ID NO: 538774
  misc_feature: HIJSMM301CKG7U.26.26.C04.1.454.light.4.raw

SEQ ID NO: 584717 - DNA, 503 bp, Homo sapiens; identical to SEQ ID NO: 551458
  misc_feature: HIJSMM301ERBJ7.19.78.H01.1.454.light.4.raw

SEQ ID NO: 584718 - DNA, 504 bp, Homo sapiens
  misc_feature: HIJSMM301B2HRP.43.62.F07.1.454.light.4.raw
tgtgagtagtcacgaccggtgctcgatttagtagtcgcataaagggaaagggcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgttcggtccacgggaccgacggtggtacg

SEQ ID NO: 584719 - DNA, 489 bp, Homo sapiens
  misc_feature: HIJSMM301B68JL.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgagcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggtaccgttcggtccaggggaccgacggtcggagtgtcaagcgaactgtggctggcaccat

SEQ ID NO: 584720 - DNA, 520 bp, Homo sapiens; identical to SEQ ID NO: 579367
  misc_feature: HIJSMM301DHBJH.27.23.C01.1.454.light.4.raw

SEQ ID NO: 584721 - DNA, 491 bp, Homo sapiens
  misc_feature: HIJSMM301AEAZ7.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcggagggaccagggtggagatcagacgaactgtggctgcaccat

SEQ ID NO: 584722 - DNA, 515 bp, Homo sapiens
  misc_feature: HIJSMM301EIVJK.7.34.D01.1.454.light.4.raw
cgtgtctctacacgaccggtgctcgatttagatcgtctgtgttgggtttgggggggtctcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccgtctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcactcttcg

SEQ ID NO: 584723 - DNA, 501 bp, Homo sapiens; identical to SEQ ID NO: 536818
  misc_feature: HIJSMM301BHD0C.12.82.H05.1.454.light.4.raw

SEQ ID NO: 584724 - DNA, 496 bp, Homo sapiens
  misc_feature: HIJSMM301A12C8.52.80.H03.1.454.light.4.raw
cgcagtacgacacgaccggtgctcgatttagctgtgcgtcgaagggaaagggggtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcacgtcctaggtcagcccaaggccaaccccactgtcactc

SEQ ID NO: 584725 - DNA, 501 bp, Homo sapiens; identical to SEQ ID NO: 536818
  misc_feature: HIJSMM301EEJKX.12.82.H05.1.454.light.4.raw

SEQ ID NO: 584726 - DNA, 498 bp, Homo sapiens
  misc_feature: HIJSMM301ERHCG.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcaggtgggtcaggcactgatttcacactgaaaatcagcagggtggaggctgaggatgttattgggctctattattgcatgcaagcaacacactggccgtactacttttggccgaggggaaccaggactggagatcaatcgaactgtggt

SEQ ID NO: 584727 - DNA, 509 bp, Homo sapiens; identical to SEQ ID NO: 543772
  misc_feature: HIJSMM301A7C9E.2.21.B10.1.454.light.4.raw

SEQ ID NO: 584728 - DNA, 514 bp, Homo sapiens
  misc_feature: HIJSMM301CVRUW.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccactgcactctcgttccccg

SEQ ID NO: 584729 - DNA, 493 bp, Homo sapiens; identical to SEQ ID NO: 535047
  misc_feature: HIJSMM301A52ZO.16.53.E09.1.454.light.4.raw

SEQ ID NO: 584730 - DNA, 500 bp, Homo sapiens
  misc_feature: HIJSMM301A1X08.52.38.D05.1.454.light.4.raw
cgcagtacgacacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 584731 - DNA, 486 bp, Homo sapiens
  misc_feature: HIJSMM301B0F62.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggttattactgcatgcaagctctacaaactccttacacttttggccaggggaccaagctggagatcaaacgaa

SEQ ID NO: 584732 - DNA, 481 bp, Homo sapiens; identical to SEQ ID NO: 535993
  misc_feature: HIJSMM301A9WAI.21.25.C03.1.454.light.4.raw

SEQ ID NO: 584733 - DNA, 480 bp, Homo sapiens
  misc_feature: HIJSMM301EI2O9.5.12.B01.1.454.light.4.raw
atcagacacgcacgaccggtgctcgatttagtagtgtagattccgcggggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagcccaaggctgccccctcggtcactctgttcccgccctcctccgtgtctgat

SEQ ID NO: 584734 - DNA, 510 bp, Homo sapiens
  misc_feature: HIJSMM301DYJ2Y.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaaacaatacttttgtcttcggaactgggaccaaggtcaccgtcctaggtcagcccaaggccaacccactgtcactctcg

SEQ ID NO: 584735 - DNA, 490 bp, Homo sapiens; identical to SEQ ID NO: 535234
  misc_feature: HIJSMM301B0G4M.17.21.B10.1.454.light.4.raw

SEQ ID NO: 584736 - DNA, 489 bp, Homo sapiens
  misc_feature: HIJSMM301DM25W.26.23.C01.1.454.light.4.raw
  modified_base (462)..(462): a, c, t, g, unknown or other
  modified_base (474)..(474): a, c, t, g, unknown or other
  modified_base (477)..(477): a, c, t, g, unknown or other
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcgccgagggaccgaaggtggaagtnaagacgaactgnggntgcacatctgtt

SEQ ID NO: 584737 - DNA, 509 bp, Homo sapiens; identical to SEQ ID NO: 539359
  misc_feature: HIJSMM301CUJSR.47.85.H08.1.454.light.4.raw

SEQ ID NO: 584738 - DNA, 495 bp, Homo sapiens; identical to SEQ ID NO: 543094
  misc_feature: HIJSMM301DARM6.22.57.F02.1.454.light.4.raw

SEQ ID NO: 584739 - DNA, 522 bp, Homo sapiens
  misc_feature: HIJSMM301C3M78.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggtccgaacgggaccgaacggtaggaagtacgaaacgaacctagtggcgtgcgaccactctgtcttctatcttcccgtcccact

SEQ ID NO: 584740 - DNA, 486 bp, Homo sapiens; identical to SEQ ID NO: 535043
  misc_feature: HIJSMM301B65KV.46.35.D02.1.454.light.4.raw

SEQ ID NO: 584741 - DNA, 487 bp, Homo sapiens
  misc_feature: HIJSMM301DIBXO.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggagtcaagcgaactgtggctgcaccatctgt

SEQ ID NO: 584742 - DNA, 510 bp, Homo sapiens
  misc_feature: HIJSMM301BB9FE.40.47.E03.1.454.light.4.raw
tctagcgactcacgaccggtgctcgatttagactcgcgcacagagagaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcggggggaccaagctgaccgtcctaggtcagcccaaggctgccccctcggtcta

SEQ ID NO: 584743 - DNA, 509 bp, Homo sapiens; identical to SEQ ID NO: 548681
  misc_feature: HIJSMM301A11CQ.47.83.H06.1.454.light.4.raw

SEQ ID NO: 584744 - DNA, 515 bp, Homo sapiens
  misc_feature: HIJSMM301ATA5O.10.38.D05.1.454.light.4.raw
catagtagtgcacgaccggtgctcgatttagtatctgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccct

SEQ ID NO: 584745 - DNA, 483 bp, Homo sapiens; identical to SEQ ID NO: 535413
  misc_feature: HIJSMM301CXCMB.26.78.H01.1.454.light.4.raw

SEQ ID NO: 584746 - DNA, 503 bp, Homo sapiens
  misc_feature: HIJSMM301CDE8O.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccgaaggtggaaatacaaacgaactgtggctgcaccatctgtcttcatcttccccg

SEQ ID NO: 584747 - DNA, 491 bp, Homo sapiens
  misc_feature: HIJSMM301AOY4M.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtgggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagattaaacgaactgtggctgcaccatctgtcttcatt

SEQ ID NO: 584748 - DNA, 517 bp, Homo sapiens
  misc_feature: HIJSMM301DSJOG.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcacctctcgttccccg

SEQ ID NO: 584749 - DNA, 507 bp, Homo sapiens
  misc_feature: HIJSMM301AIAG7.40.43.D10.1.454.light.4.raw
tctagcgactcacgaccggtgctcgatttagactagcagtaagggggaggaactgctcagttaggacccagagggaaccatggaagccccagctcagcttctcttcctcctgctactctggctcccagaaaacaccggagaaattctgttgacacagtctccaggcaccctgtctttgtctccaggggaaagagccaccctctcctgcagggccagtcagagtgtcggcaccttcttagcctggtaccaacagaagcctggccaggctcccaggctcctcatttatgaagcgtcgaacagggccactggcatcccagccaggttcagtgccagtgggtctgggacagacttcactctcaccatcagcagcctagagcctgaagattttgcactttattactgtcaccagcgtagcagctggcctcgaacgttcggtccaagggaccgaaggtggacgatcaagcgaactgtggctgcaccactctgtcttcactcttcccgtccact

SEQ ID NO: 584750 - DNA, 490 bp, Homo sapiens; identical to SEQ ID NO: 544667
  misc_feature: HIJSMM301DV9CJ.12.23.C01.1.454.light.4.raw

SEQ ID NO: 584751 - DNA, 518 bp, Homo sapiens; identical to SEQ ID NO: 539372
  misc_feature: HIJSMM301AE1GL.7.86.H09.1.454.light.4.raw

SEQ ID NO: 584752 - DNA, 501 bp, Homo sapiens
  misc_feature: HIJSMM301DZNO6.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctggggacagatttcactctcaccatcagcagccttcaggctgaagatgtggcagtttattactgtcagcaatattatatctctcctcctcggacgttcgccaagggaccacggtggaatacaacgaactagtggctgcaccatctgtcttctatcttcccgccact

SEQ ID NO: 584753 - DNA, 447 bp, Homo sapiens; identical to SEQ ID NO: 535201
  misc_feature: HIJSMM301EZYLC.18.9.A09.1.454.light.4.raw

SEQ ID NO: 584754 - DNA, 474 bp, Homo sapiens
  misc_feature: HIJSMM301ASLMB.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctccttccgagtgcctacttttggcggggggaccaaggtggacatcaaacgaa

SEQ ID NO: 584755 - DNA, 503 bp, Homo sapiens; identical to SEQ ID NO: 538884
  misc_feature: HIJSMM301A823F.27.78.H01.1.454.light.4.raw

SEQ ID NO: 584756 - DNA, 497 bp, Homo sapiens; identical to SEQ ID NO: 536462
  misc_feature: HIJSMM301DTEQJ.41.20.B09.1.454.light.4.raw

SEQ ID NO: 584757 - DNA, 491 bp, Homo sapiens; identical to SEQ ID NO: 550090
  misc_feature: HIJSMM301DD01R.16.68.G02.1.454.light.4.raw

SEQ ID NO: 584758 - DNA, 504 bp, Homo sapiens; identical to SEQ ID NO: 544267
  misc_feature: HIJSMM301EMFAG.19.85.H08.1.454.light.4.raw

SEQ ID NO: 584759 - DNA, 489 bp, Homo sapiens
  misc_feature: HIJSMM301BLU72.13.87.H10.1.454.light.4.raw
tcacgtactacacgaccggtgctcgatttagcagtactgcgttgggtttgggggagtcagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcaggacattaacagttatttagtctggtatcagcaaaaaccagggaaagtccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggccaaggtggagatcaaaacgaactgtggctgcaccatctgtt

SEQ ID NO: 584760 - DNA, 488 bp, Homo sapiens; identical to SEQ ID NO: 538811
  misc_feature: HIJSMM301BHYE1.40.83.H06.1.454.light.4.raw

SEQ ID NO: 584761 - DNA, 501 bp, Homo sapiens
  misc_feature: HIJSMM301C3ING.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctggacccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagcccaaggccaacccactgtca

SEQ ID NO: 584762 - DNA, 493 bp, Homo sapiens
  misc_feature: HIJSMM301AETJ8.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctctttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaactgtggc

SEQ ID NO: 584763 - DNA, 507 bp, Homo sapiens
  misc_feature: HIJSMM301C2H8E.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccaagggaccgaacggtaggaaagtacaaacgaacgtacgtggcgtgcaccactct

SEQ ID NO: 584764 - DNA, 513 bp, Homo sapiens
  misc_feature: HIJSMM301CEXZ1.9.74.G08.1.454.light.4.raw
tgatacgtctcacgaccggtgctcgatttagtagctctatcaggggctgggcctaaggaagcagcactggtggtgcctcagccatggcctggaccgttctcctcctcggcctcctctctcactgcacaggctctgtgacgtcccctgtgctgactcagccaccctcggtgtcagtggccccaggaaagacggccaggataacctgtgagggaaataacattggaagtaaagtgtgcactggtatcagcagaggccaggccaggcccctgtactggtcctctatgatgacagtggccggccctcagggatccctgagcgattctctggctccaagtctggcagcacggccaccctgaccatcagcagggtcgaagccggggatgaggccgactattactgtcaggtgtggagttttaatagtgatcatccgggggtattcggcggagggaccaaggtgaccgtcctacgtcagcccaaggctgccccctcggtcactctgttcccaccctcctc

SEQ ID NO: 584765 - DNA, 512 bp, Homo sapiens
  misc_feature: HIJSMM301EHRV0.5.27.C05.1.454.light.4.raw
  modified_base (479)..(479): a, c, t, g, unknown or other
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggccccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccacngtcactctgttcccaccctcctccgtgtctgat

SEQ ID NO: 584766 - DNA, 383 bp, Homo sapiens; identical to SEQ ID NO: 577879
  misc_feature: HIJSMM301ALO88.41.35.D02.1.454.light.4.raw

SEQ ID NO: 584767 - DNA, 493 bp, Homo sapiens; identical to SEQ ID NO: 543554
  misc_feature: HIJSMM301BG3GN.10.77.G11.1.454.light.4.raw

SEQ ID NO: 584768 - DNA, 497 bp, Homo sapiens; identical to SEQ ID NO: 535991
  misc_feature: HIJSMM301ASKKO.48.31.C09.1.454.light.4.raw

SEQ ID NO: 584769 - DNA, 509 bp, Homo sapiens
  misc_feature: HIJSMM301BNRS3.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggccgaacgggaccgaacggtggaaagtacaaacgaactagtggcgtgcgaccactctgtt

SEQ ID NO: 584770 - DNA, 504 bp, Homo sapiens
  misc_feature: HIJSMM301D1SLV.48.27.C05.1.454.light.4.raw
agtatacatacacgaccggtgctcgatttagacgcgatcgaagggtttgggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccctcggt

SEQ ID NO: 584771 - DNA, 503 bp, Homo sapiens
  misc_feature: HIJSMM301CDIFV.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaaccgtcctaggtcagcccaaggctgccccctc

SEQ ID NO: 584772 - DNA, 486 bp, Homo sapiens
  misc_feature: HIJSMM301BDH77.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctcccactttcggccctgggaccaaagtggatatcaaacgaaactgtggctgcaccatctgtt

SEQ ID NO: 584773 - DNA, 521 bp, Homo sapiens; identical to SEQ ID NO: 565479
  misc_feature: HIJSMM301DMMG1.27.23.C01.1.454.light.4.raw

SEQ ID NO: 584774 - DNA, 503 bp, Homo sapiens; identical to SEQ ID NO: 543299
  misc_feature: HIJSMM301A8VOB.48.36.D03.1.454.light.4.raw

SEQ ID NO: 584775 - DNA, 504 bp, Homo sapiens; identical to SEQ ID NO: 555616
  misc_feature: HIJSMM301BN2T6.5.86.H09.1.454.light.4.raw

SEQ ID NO: 584776 - DNA, 495 bp, Homo sapiens; identical to SEQ ID NO: 584047
  misc_feature: HIJSMM301D60R8.3.33.C11.1.454.light.4.raw

SEQ ID NO: 584777 - DNA, 481 bp, Homo sapiens
  misc_feature: HIJSMM301A6PNY.16.81.H04.1.454.light.4.raw
tgtactactccacgaccggtgctcgatttagtagtgtagattcgcgggggactcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactgtggctgcaccatctgt

SEQ ID NO: 584778 - DNA, 504 bp, Homo sapiens
  misc_feature: HIJSMM301A6LMN.21.22.B11.1.454.light.4.raw
  modified_base (461)..(461): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtnttcgggcggagggaccaaactgaccgtcctaaggtcagcccaa

SEQ ID NO: 584779 - DNA, 498 bp, Homo sapiens
  misc_feature: HIJSMM301DK0BI.11.75.G09.1.454.light.4.raw
cgagagataccacgaccggtgctcgatttagtatagacatcagggggctctgcttcagctgtgggcacaagaggcagcactcaggacaatctccaacatggcctggtctcctctcctcctcactctcctcgctcactgcacagggtcctgggcccagtctgcgctgacgcagccgccctcagtgtctggggccccagggcagagggtcgccatctcctgcactgggtccacctccaatatcggggccggttatggtatgctctggtatcaacaacgtccaggaatggcccccaaatcctcatctatgctgacaacaatcgaccttcaggggtccctgaccggttctctggctccaagtctggctcttccgcctccttggccatcactgggctcgaggctgacgatgaggctgattactactgtctgtcctatgacgacgacctacagactcccggttttcggcggagggactaagctgaccgtcctaagtcagcccaa

SEQ ID NO: 584780 - DNA, 485 bp, Homo sapiens; identical to SEQ ID NO: 535501
  misc_feature: HIJSMM301C0D8I.3.10.A10.1.454.light.4.raw

SEQ ID NO: 584781 - DNA, 498 bp, Homo sapiens; identical to SEQ ID NO: 535974
  misc_feature: HIJSMM301B6ZCE.22.27.C05.1.454.light.4.raw

SEQ ID NO: 584782 - DNA, 488 bp, Homo sapiens; identical to SEQ ID NO: 541987
  misc_feature: HIJSMM301AO3XH.8.12.B01.1.454.light.4.raw

SEQ ID NO: 584783 - DNA, 447 bp, Homo sapiens; identical to SEQ ID NO: 535020
  misc_feature: HIJSMM301BX2I1.18.9.A09.1.454.light.4.raw

SEQ ID NO: 584784 - DNA, 496 bp, Homo sapiens
  misc_feature: HIJSMM301D368P.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcagcgtagcaactccctcacgttcggcggaggggaccaaggtggagatcaaacgaactgtggctgcaccatctgtcttcatcttcccgcc

SEQ ID NO: 584785 - DNA, 383 bp, Homo sapiens; identical to SEQ ID NO: 447524
  misc_feature: HIJSMM301BHMME.41.26.C04.1.454.light.4.raw

SEQ ID NO: 584786 - DNA, 509 bp, Homo sapiens
  misc_feature: HIJSMM301CWDPR.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtcccactgtgatcttcggcggggggaccaaggctgaccgtcctaggtcagcccaacggctgccccccg

SEQ ID NO: 584787 - DNA, 487 bp, Homo sapiens
  misc_feature: HIJSMM301EJEI6.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcacgtctcaccatcagcagtctgcaacctgaagatttgcaacttactactgtcaacagagttacggtacccgtacacttttggccaggggaccaaactggacatcaaacgaactgtggctgcaccatctgtt

SEQ ID NO: 584788 - DNA, 490 bp, Homo sapiens; identical to SEQ ID NO: 541567
  misc_feature: HIJSMM301AMM75.22.65.F10.1.454.light.4.raw

SEQ ID NO: 584789 - DNA, 472 bp, Homo sapiens; identical to SEQ ID NO: 536302
  misc_feature: HIJSMM301BI2W0.18.76.G10.1.454.light.4.raw

SEQ ID NO: 584790 - DNA, 487 bp, Homo sapiens; identical to SEQ ID NO: 535583
  misc_feature: HIJSMM301CJORK.22.73.G07.1.454.light.4.raw

SEQ ID NO: 584791 - DNA, 481 bp, Homo sapiens
  misc_feature: HIJSMM301DH6ZF.16.81.H04.1.454.light.4.raw
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaactttcggccctgggaccaatgtggatatcaaacgaactagtggctgcacatctgtt

SEQ ID NO: 584792 - DNA, 516 bp, Homo sapiens
  misc_feature: HIJSMM301BCS8F.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcgcaacggacgaacggtaggaagtacaagacgaactgtggctgcaccaatctgtcttctatcttcccgcccact

SEQ ID NO: 584793 - DNA, 507 bp, Homo sapiens
  misc_feature: HIJSMM301EPG45.17.41.D08.1.454.light.4.raw
cgtagactagcacgaccggtgctcgatttagtcacgcgagaaagggaaaggggagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtagtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttcatcttcccgcc

SEQ ID NO: 584794 - DNA, 487 bp, Homo sapiens; identical to SEQ ID NO: 536536
  misc_feature: HIJSMM301ASH3P.26.45.E01.1.454.light.4.raw

SEQ ID NO: 584795 - DNA, 442 bp, Homo sapiens
  misc_feature: HIJSMM301D5F3S.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttccccctcctctgtcgagcgt

SEQ ID NO: 584796 - DNA, 469 bp, Homo sapiens; identical to SEQ ID NO: 536091
  misc_feature: HIJSMM301DFUXX.3.82.H05.1.454.light.4.raw

SEQ ID NO: 584797 - DNA, 504 bp, Homo sapiens
  misc_feature: HIJSMM301D0JHD.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcaggtgggtctgggacagtacttcactctcaccatcagcagcctagacgcctagaagtattttgctagtttattactgtcagcagcgtagcaactcggcctctccaccgttcgggcggacgggaccaagggtggagatacaaacgaactgtggctgcaccatctgtt

SEQ ID NO: 584798 - DNA, 484 bp, Homo sapiens
  misc_feature: HIJSMM301AYP6I.52.23.C01.1.454.light.4.raw
  modified_base (418)..(418): a, c, t, g, unknown or other
cgcagtacgacacgaccggtgctcgatttagtacacgtgattagggattggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaataatnaagatctcccctcactttcggcggagggaccaaaggtggagatcagacgaactgtggctgcaccat

SEQ ID NO: 584799 - DNA, 494 bp, Homo sapiens; identical to SEQ ID NO: 534992
  misc_feature: HIJSMM301ECTBY.9.1.A01.1.454.light.4.raw

SEQ ID NO: 584800 - DNA, 520 bp, Homo sapiens; identical to SEQ ID NO: 558856
  misc_feature: HIJSMM301CUMXV.12.71.G05.1.454.light.4.raw

SEQ ID NO: 584801 - DNA, 502 bp, Homo sapiens
  misc_feature: HIJSMM301ELIWK.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactaagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcaatgtggttttcggcggggggaccaaaggtgaccgtcctaggtcagcccaaggctccg

SEQ ID NO: 584802 - DNA, 494 bp, Homo sapiens; identical to SEQ ID NO: 540110
  misc_feature: HIJSMM301DFA3Y.51.71.G05.1.454.light.4.raw

SEQ ID NO: 584803 - DNA, 504 bp, Homo sapiens; identical to SEQ ID NO: 539175
  misc_feature: HIJSMM301E0Y75.48.53.E09.1.454.light.4.raw

SEQ ID NO: 584804 - DNA, 509 bp, Homo sapiens
  misc_feature: HIJSMM301C61V6.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctcgggaccgaaggtggagatcaaacgaactgtggctgcaccatctgtcttcta

SEQ ID NO: 584805 - DNA, 500 bp, Homo sapiens; identical to SEQ ID NO: 581055
  misc_feature: HIJSMM301CHMFA.15.1.A01.1.454.light.4.raw

SEQ ID NO: 584806 - DNA, 502 bp, Homo sapiens
  misc_feature: HIJSMM301BIXM0.51.9.A09.1.454.light.4.raw
cgatcgtatacacgaccggtgctcgatttagcgagacgcgcagggggactgcgggggtaagaggttgtgtccaccatggcctggactcctctcctcctcctgttcctctctcactgcacaggttccctctcgcaggctgtgctgactcagccgtcttccctgtctgcatctcctggagcatcagccagtctcacctgcaccttgcgcagtggcttcgatgttagtacctacaggatatactggttccagcagaaggcagggagtcctccccagtttctcctaaattacaaatctgactcacgtaagcagcagggctctggagtccccagccgcttctctggatccaaagatgcttcggccaatgcggggattttactcatctctgggctccagtctgaggatgaggctgactattactgtttgatttggcacagcagcgcttgggtattcggcggggggaccgaaactgaccgtcctaggtcagcccaaggctgtccccccg

SEQ ID NO: 584807 - DNA, 493 bp, Homo sapiens
  misc_feature: HIJSMM301AE7KF.13.11.A11.1.454.light.4.raw
tcacgtactacacgaccggtgctcgatttagctacgactgcaggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagcctacatcacctgctctggagatgtattgactaacgagtatggttcctggtatcagcagaaggcaggccagccccctgtcctactcatctttcaaataccaggcggccctctggggtccctgagcgattctccggctccgcctctgggaacacagtcactctgaccatcagcgggacccagcctattgatgaggctgtctacttctgtcaggcgtgggacaacagcgtgctgttcggcggagggaccagtctgaccgtcttaggtcagcccaaggctgccccctcggtcactctgttccca

SEQ ID NO: 584808 - DNA, 498 bp, Homo sapiens; identical to SEQ ID NO: 547944
  misc_feature: HIJSMM301EV235.41.53.E09.1.454.light.4.raw

SEQ ID NO: 584809 - DNA, 508 bp, Homo sapiens
  misc_feature: HIJSMM301BJL7F.21.22.B11.1.454.light.4.raw
  modified_base (431)..(431): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctcgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcgacgggacncaacatgggatgacaatctggagcgggttgggtgttcgggcgggagggaccaaactgaccgtcctaggtcagcccaa

SEQ ID NO: 584810 - DNA, 460 bp, Homo sapiens
  misc_feature: HIJSMM301CYKGL.19.71.G05.1.454.light.4.raw
tactctcgtgcacgaccggtgctcgatttagtgtcgtcgcaagagagagggggcacttctccctctaacactctccccagtctccagactccctggctgtgtctctgggcgagcggggccaccgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagattttcactctcaccatcagcagcctgcaggctgaagatgtggcagtttattattgtcaacaatattattatacttcgtggacgttcggccaagggaccaaggtggatatcagacgaatgtggctgcaccatctgtcttcattcttcccgccatctgacacgagagta

SEQ ID NO: 584811 - DNA, 475 bp, Homo sapiens
  misc_feature: HIJSMM301CI7MU.15.81.H04.1.454.light.4.raw
tctacgtagccacgaccggtgctcgatttagtagtgtagattcgcggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgctacgtaga

SEQ ID NO: 584812 - DNA, 493 bp, Homo sapiens
  misc_feature: HIJSMM301AUECW.52.54.E10.1.454.light.4.raw
cgcagtacgacacgaccggtgctcgatttagatcgtagcagaacacacaaagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagcccaaggccaaccccac

SEQ ID NO: 584813 - DNA, 444 bp, Homo sapiens; identical to SEQ ID NO: 540477
  misc_feature: HIJSMM301CP02W.17.21.B10.1.454.light.4.raw

SEQ ID NO: 584814 - DNA, 495 bp, Homo sapiens; identical to SEQ ID NO: 535007
  misc_feature: HIJSMM301ELN6A.22.5.A05.1.454.light.4.raw

SEQ ID NO: 584815 - DNA, 494 bp, Homo sapiens
  misc_feature: HIJSMM301C9QUM.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggccgggggaccgaaagctggaaatcaagcgaactgtggctgcaccatctgtcttcat

SEQ ID NO: 584816 - DNA, 504 bp, Homo sapiens; identical to SEQ ID NO: 540089
  misc_feature: HIJSMM301CGT75.3.53.E09.1.454.light.4.raw

SEQ ID NO: 584817 - DNA, 497 bp, Homo sapiens
  misc_feature: HIJSMM301BX1N0.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaacctcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctccg

SEQ ID NO: 584818 - DNA, 499 bp, Homo sapiens
  misc_feature: HIJSMM301CNK37.11.67.G01.1.454.light.4.raw
cgagagataccacgaccggtgctcgatttagagtatacatattgggtttggggcagcttcaactgtgggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctcctggcctgcagtgggctccagtctgaggatgaggctgactattattgtgcagcgtgggatgacggtctgagtgctgtggtcttcggcggagggaccaaggctgaccgtcctgggtcagcccaa

SEQ ID NO: 584819 - DNA, 490 bp, Homo sapiens
  misc_feature: HIJSMM301AGX2J.52.33.C11.1.454.light.4.raw
cgcagtacgacacgaccggtgctcgatttagagtgagctcgttgggtttggggtggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagccctccagtctgaggacgagggtgactattactgtcagacgtgggacactggcatttgggtgttcggcggagggaccaagttgaccgtcctaggtcagcccaaggctgccccctcggtca

SEQ ID NO: 584820 - DNA, 494 bp, Homo sapiens
  misc_feature: HIJSMM301DT42U.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcatt

SEQ ID NO: 584821 - DNA, 454 bp, Homo sapiens; identical to SEQ ID NO: 535005
  misc_feature: HIJSMM301C4UVT.19.86.H09.1.454.light.4.raw

SEQ ID NO: 584822 - DNA, 494 bp, Homo sapiens; identical to SEQ ID NO: 534992
  misc_feature: HIJSMM301CEVLG.9.1.A01.1.454.light.4.raw

SEQ ID NO: 584823 - DNA, 484 bp, Homo sapiens; identical to SEQ ID NO: 535211
  misc_feature: HIJSMM301CWW8F.47.46.E02.1.454.light.4.raw

SEQ ID NO: 584824 - DNA, 498 bp, Homo sapiens
  misc_feature: HIJSMM301EBJDW.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggaccaagggacacgactggagtattaaaggaactggtggctgcaccatctgtcttcatccttccccg

SEQ ID NO: 584825 - DNA, 488 bp, Homo sapiens; identical to SEQ ID NO: 543314
  misc_feature: HIJSMM301CHTWB.3.33.C11.1.454.light.4.raw

SEQ ID NO: 584826 - DNA, 491 bp, Homo sapiens
  misc_feature: HIJSMM301EV45T.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaagggcggagatcagacgaactgtggctgcaccatctgtcttcta

SEQ ID NO: 584827 - DNA, 486 bp, Homo sapiens; identical to SEQ ID NO: 535187
  misc_feature: HIJSMM301EVZQC.49.35.D02.1.454.light.4.raw

SEQ ID NO: 584828 - DNA, 454 bp, Homo sapiens; identical to SEQ ID NO: 536347
  misc_feature: HIJSMM301AYTW7.19.86.H09.1.454.light.4.raw

SEQ ID NO: 584829 - DNA, 488 bp, Homo sapiens
  misc_feature: HIJSMM301AJN7X.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaaattcttatcgggtggttcggcgggaggaccaagctgaccgtccta

SEQ ID NO: 584830 - DNA, 491 bp, Homo sapiens; identical to SEQ ID NO: 540256
  misc_feature: HIJSMM301D28U3.46.67.G01.1.454.light.4.raw

SEQ ID NO: 584831 - DNA, 463 bp, Homo sapiens; identical to SEQ ID NO: 535062
  misc_feature: HIJSMM301AUYAR.11.73.G07.1.454.light.4.raw

SEQ ID NO: 584832 - DNA, 482 bp, Homo sapiens
  misc_feature: HIJSMM301B5GBR.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgagctgactattatgtcaatcaacagacagtagtgggaaatatgtggtattcggcggagggaccaaactgaccgtctaggtcagcccaaggctgccccccg

SEQ ID NO: 584833 - DNA, 494 bp, Homo sapiens; identical to SEQ ID NO: 534992
  misc_feature: HIJSMM301DJV3V.9.1.A01.1.454.light.4.raw

SEQ ID NO: 584834 - DNA, 489 bp, Homo sapiens
  misc_feature: HIJSMM301DBOND.3.79.H02.1.454.light.4.raw
agacgcactccacgaccggtgctcgatttagtgtcacacgaagggaaagggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgtttcggcggagggaccaagctgaccgtcctaggtcagcccaaggctcg

SEQ ID NO: 584835 - DNA, 492 bp, Homo sapiens; identical to SEQ ID NO: 538317
  misc_feature: HIJSMM301CDFDY.10.17.B06.1.454.light.4.raw

SEQ ID NO: 584836 - DNA, 487 bp, Homo sapiens
  misc_feature: HIJSMM301ARF1A.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctggacc

SEQ ID NO: 584837 - DNA, 496 bp, Homo sapiens
  misc_feature: HIJSMM301COK5J.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcggggtcagagttcactctcaccatcagcagcctgcagtctgaagattttgcagtttattactgtcagcagtatgatacctggcctccgtacacttttggtccggggaccgaagactggaaatacaagacgaactgtggctgcaccatctgtcttcat

SEQ ID NO: 584838 - DNA, 486 bp, Homo sapiens
  misc_feature: HIJSMM301CUC5R.9.64.F09.1.454.light.4.raw
tgatacgtctcacgaccggtgctcgatttagcgcgtatacaaggggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccggtccactcagagtatgagtacttggttggcctggtatcagcagaaaccagggaaagcccctaaactcctaatctatgatgcctccattttggaaagtggggtcccatcaaggttcagcggcagtggatctgggacagaattcactctcaccatcagcagcctgcagcctgatgattttgcaacttatactgccaacgccataactggtatttcggccctgggaccaaagtggatgtcaaacgaactgtggctgcaccatctgtcttcatcttccccg

SEQ ID NO: 584839 - DNA, 512 bp, Homo sapiens
  misc_feature: HIJSMM301D87ZN.40.71.G05.1.454.light.4.raw
tctagcgactcacgaccggtgctcgatttagtgtcgtcgcaagagagaggggaggggggtgagggttgagaacctatgaacattctgtaggggccactgtcttctccacggtgctcccttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccacctgggcatcaccggactccagactggcgacgaggccgtttattattgcggaacatgggatagcggcctgagtgatgagtggatgttcggcggcgggaccaaactgaccgtcta

SEQ ID NO: 584840 - DNA, 502 bp, Homo sapiens; identical to SEQ ID NO: 541971
  misc_feature: HIJSMM301BNWG4.4.39.D06.1.454.light.4.raw

SEQ ID NO: 584841 - DNA, 496 bp, Homo sapiens
  misc_feature: HIJSMM301CF9ZN.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaaggtggaggatacaaagaacctgtggcg

SEQ ID NO: 584842 - DNA, 447 bp, Homo sapiens; identical to SEQ ID NO: 535020
  misc_feature: HIJSMM301BYJ5V.18.9.A09.1.454.light.4.raw

SEQ ID NO: 584843 - DNA, 498 bp, Homo sapiens
  misc_feature: HIJSMM301CGL9I.5.24.C02.1.454.light.4.raw
  modified_base (474)..(474): a, c, t, g, unknown or other
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagcngaccgtctaggtcagcccaaggct

SEQ ID NO: 584844 - DNA, 495 bp, Homo sapiens; identical to SEQ ID NO: 536931
  misc_feature: HIJSMM301ATZEW.10.33.C11.1.454.light.4.raw

SEQ ID NO: 584845 - DNA, 489 bp, Homo sapiens
  misc_feature: HIJSMM301CQZAX.16.72.G06.1.454.light.4.raw
  modified_base (199)..(199): a, c, t, g, unknown or other
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaanagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtggagatcaaacgaactgtggctgcaccat

SEQ ID NO: 584846 - DNA, 494 bp, Homo sapiens; identical to SEQ ID NO: 534994
  misc_feature: HIJSMM301CV5VI.27.78.H01.1.454.light.4.raw

SEQ ID NO: 584847 - DNA, 522 bp, Homo sapiens
  misc_feature: HIJSMM301DU6D1.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggacaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctcgcccctcggtcactctcgttcccaccct

SEQ ID NO: 584848 - DNA, 477 bp, Homo sapiens; identical to SEQ ID NO: 535266
  misc_feature: HIJSMM301D4D85.4.34.D01.1.454.light.4.raw

SEQ ID NO: 584849 - DNA, 484 bp, Homo sapiens; identical to SEQ ID NO: 535240
  misc_feature: HIJSMM301D00N1.47.60.F05.1.454.light.4.raw

SEQ ID NO: 584850 - DNA, 503 bp, Homo sapiens
  misc_feature: HIJSMM301C48OA.13.53.E09.1.454.light.4.raw
  modified_base (461)..(461): a, c, t, g, unknown or other
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggacgtcgtcacggacaacgtaggaatacaanacgaactagtggcgtgcaccatctgtcttctactcttcccgt

SEQ ID NO: 584851 - DNA, 460 bp, Homo sapiens; identical to SEQ ID NO: 536053
  misc_feature: HIJSMM301B4J28.22.28.C06.1.454.light.4.raw

SEQ ID NO: 584852 - DNA, 493 bp, Homo sapiens
  misc_feature: HIJSMM301CI2G2.12.38.D05.1.454.light.4.raw
atacgacgtacacgaccggtgctcgatttagtatctgatagttgggtttggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccatctgtcttcat

SEQ ID NO: 584853 - DNA, 454 bp, Homo sapiens; identical to SEQ ID NO: 536347
  misc_feature: HIJSMM301ER9N5.19.86.H09.1.454.light.4.raw

SEQ ID NO: 584854 - DNA, 500 bp, Homo sapiens; identical to SEQ ID NO: 541228
  misc_feature: HIJSMM301EE05R.13.11.A11.1.454.light.4.raw

SEQ ID NO: 584855 - DNA, 486 bp, Homo sapiens; identical to SEQ ID NO: 535290
  misc_feature: HIJSMM301CIXVI.3.12.B01.1.454.light.4.raw

SEQ ID NO: 584856 - DNA, 487 bp, Homo sapiens
  misc_feature: HIJSMM301A5SB4.43.33.C11.1.454.light.4.raw
tgtgagtagtcacgaccggtgctcgatttagagtgagctcgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacaatttcggtcaggggaccaattgaacatcaatcgaactgtggctgcaccat

SEQ ID NO: 584857 - DNA, 489 bp, Homo sapiens
  misc_feature: HIJSMM301AUKIY.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctcgcccccaaccttccggccgaggggacacgactggagattaaacgaactgtggctgcaccatctgtt

SEQ ID NO: 584858 - DNA, 492 bp, Homo sapiens
  misc_feature: HIJSMM301ATRIG.21.9.A09.1.454.light.4.raw
tcgtcgctcgcacgaccggtgctcgatttagcgagacgcgcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtggggggcagagtctccatcacttgccgggccagtcagaatatttatagctggttggcctggtatcagcagaaaccagggaaagcccctaacctcctgatatatcgggcgtctaatttagaaagtggggtcccatcgaggttcagcggcagtggctctgggacagaattcactctcaccatcagcggcctgcagcccgatgattttgcaacttattactgccaacattacaatgattactcgcgtacgttcggccaagggaccagggtggaaatacaaacgaactgtggctgcaccatctgtcttcat

SEQ ID NO: 584859 - DNA, 482 bp, Homo sapiens; identical to SEQ ID NO: 540521
  misc_feature: HIJSMM301C623A.21.25.C03.1.454.light.4.raw

SEQ ID NO: 584860 - DNA, 468 bp, Homo sapiens
  misc_feature: HIJSMM301AL9ES.52.59.F04.1.454.light.4.raw
  modified_base (429)..(429): a, c, t, g, unknown or other
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcagggtcccatctcggttcgttggcagtgggtctgggacagattttactctcaccatcagcagcctgcagcctgaagatgttgcaacttatttctgtcataactatgatgatgcccctnacacgttcggccaagggaccaagctaggaaatcaaacga

SEQ ID NO: 584861 - DNA, 415 bp, Homo sapiens
  misc_feature: HIJSMM301C5ZML.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccactgtcactctgttcccaccctcctccatactcgta

SEQ ID NO: 584862 - DNA, 514 bp, Homo sapiens; identical to SEQ ID NO: 539694
  misc_feature: HIJSMM301DAOIF.15.86.H09.1.454.light.4.raw

SEQ ID NO: 584863 - DNA, 485 bp, Homo sapiens; identical to SEQ ID NO: 536040
  misc_feature: HIJSMM301CBKQX.15.1.A01.1.454.light.4.raw

SEQ ID NO: 584864 - DNA, 491 bp, Homo sapiens; identical to SEQ ID NO: 535194
  misc_feature: HIJSMM301DQ2IB.26.78.H01.1.454.light.4.raw

SEQ ID NO: 584865 - DNA, 454 bp, Homo sapiens; identical to SEQ ID NO: 536347
  misc_feature: HIJSMM301BYB01.19.86.H09.1.454.light.4.raw

SEQ ID NO: 584866 - DNA, 503 bp, Homo sapiens
  misc_feature: HIJSMM301BFD3M.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggcccccggttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcggggtgttcggcggagggaccaagctgaccgtcctaggtcagaccccg

SEQ ID NO: 584867 - DNA, 509 bp, Homo sapiens; identical to SEQ ID NO: 543266
  misc_feature: HIJSMM301EYNPU.17.33.C11.1.454.light.4.raw

SEQ ID NO: 584868 - DNA, 496 bp, Homo sapiens
  misc_feature: HIJSMM301DMDE7.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccaagggaccgaaggtcggaaagtactaaacgaacctagtggctggcaccata

SEQ ID NO: 584869 - DNA, 493 bp, Homo sapiens; identical to SEQ ID NO: 535084
  misc_feature: HIJSMM301A2VK8.47.64.F09.1.454.light.4.raw

SEQ ID NO: 584870 - DNA, 508 bp, Homo sapiens
  misc_feature: HIJSMM301DHHIC.48.15.B04.1.454.light.4.raw
agtatacatacacgaccggtgctcgatttagacagtatatatccgcgggcacgaccggtgctcgatttagtgctatagacttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacg

SEQ ID NO: 584871 - DNA, 499 bp, Homo sapiens; identical to SEQ ID NO: 536187
  misc_feature: HIJSMM301C5Z2S.11.67.G01.1.454.light.4.raw

SEQ ID NO: 584872 - DNA, 524 bp, Homo sapiens
  misc_feature: HIJSMM301BON9W.43.59.F04.1.454.light.4.raw
tgtgagtagtcacgaccggtgctcgatttagtacacacacttagggattggggtggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggacgtcagttgaccgtcctaggtcagcccaaggctgccccctcggtcactctgttcccgccctcctcactactca

SEQ ID NO: 584873 - DNA, 507 bp, Homo sapiens; identical to SEQ ID NO: 535641
  misc_feature: HIJSMM301DO8QE.10.88.H11.1.454.light.4.raw

SEQ ID NO: 584874 - DNA, 447 bp, Homo sapiens; identical to SEQ ID NO: 535201
  misc_feature: HIJSMM301DRME5.18.9.A09.1.454.light.4.raw

SEQ ID NO: 584875 - DNA, 490 bp, Homo sapiens; identical to SEQ ID NO: 535936
  misc_feature: HIJSMM301EBUOF.16.68.G02.1.454.light.4.raw

SEQ ID NO: 584876 - DNA, 522 bp, Homo sapiens
  misc_feature: HIJSMM301CK8DU.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcaccccggacgttcgtccaacgggaccgaacggtaggaagtacgaaacgaacgtagtggcgtgcaccactactcgtcttcctactccttcccgccctact

SEQ ID NO: 584877 - DNA, 448 bp, Homo sapiens; identical to SEQ ID NO: 538166
  misc_feature: HIJSMM301C2UXM.18.9.A09.1.454.light.4.raw

SEQ ID NO: 584878 - DNA, 504 bp, Homo sapiens; identical to SEQ ID NO: 563516
  misc_feature: HIJSMM301DNKA2.12.53.E09.1.454.light.4.raw

SEQ ID NO: 584879 - DNA, 478 bp, Homo sapiens
  misc_feature: HIJSMM301CXXFK.26.72.G06.1.454.light.4.raw
agactatactcacgaccggtgctcgatttagctacgactgcaagggaaagggtgagatccctcactgtggctcactttcagcggagggaccacggtggagatcacacgtaagtgcactttcctaatgctttttcttataaggttttaagtttggagcgtttttgtgtttgagatgttagctcaggtcaattccaaagagtaccagattctttcaaaagtcagatgagtaagggatagaaaattagttcaccttaaggaacagccaagcgctagccagttaagtgaggcatctcaattgcaaggttttctctgcatcggtcaggttagtgatattaacagcgaaaagagatttttgttaaggggaaagtaatagaagttaacactgtggatcaccttcggccaagggacacgactggagattaaacgaactgtggctgcaccatctgtcttcatcttcccgccatctgaagtatagtct

SEQ ID NO: 584880 - DNA, 495 bp, Homo sapiens
  misc_feature: HIJSMM301D27V2.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgagtgttcggcggagggaccgagctgaccgtcctacgtcagcccaac

SEQ ID NO: 584881 - DNA, 404 bp, Homo sapiens; identical to SEQ ID NO: 535779
  misc_feature: HIJSMM301AIKJA.4.35.D02.1.454.light.4.raw

SEQ ID NO: 584882 - DNA, 504 bp, Homo sapiens
  misc_feature: HIJSMM301ANDLJ.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcacgcccaaggctcgccccctcc

SEQ ID NO: 584883 - DNA, 480 bp, Homo sapiens; identical to SEQ ID NO: 556377
  misc_feature: HIJSMM301A2RFG.40.59.F04.1.454.light.4.raw

SEQ ID NO: 584884 - DNA, 501 bp, Homo sapiens; identical to SEQ ID NO: 557427
  misc_feature: HIJSMM301EIFIM.17.27.C05.1.454.light.4.raw

SEQ ID NO: 584885 - DNA, 505 bp, Homo sapiens
  misc_feature: HIJSMM301EBCUK.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtacaaacgaactagtggctgcaccatctgtcttcatt

SEQ ID NO: 584886 - DNA, 500 bp, Homo sapiens
  misc_feature: HIJSMM301CGMVP.15.1.A01.1.454.light.4.raw
tctacgtagccacgaccggtgctcgatttagacgtctcatcagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcact

SEQ ID NO: 584887 - DNA, 485 bp, Homo sapiens
  misc_feature: HIJSMM301BP0BE.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccggccggttctctggagtgccagaaaggttcagtggcagcgggtcagggacagatttcacactgaaaatcagccgggtggggctgaggatgttggcatttattactgcatgcaggctatacaccttcctgccacttttggccaggggaccaagctggagatcaggcgaa

SEQ ID NO: 584888 - DNA, 495 bp, Homo sapiens; identical to SEQ ID NO: 569769
  misc_feature: HIJSMM301B1N8D.9.1.A01.1.454.light.4.raw

SEQ ID NO: 584889 - DNA, 495 bp, Homo sapiens
  misc_feature: HIJSMM301C4YS7.14.30.C08.1.454.light.4.raw
cgtctagtaccacgaccggtgctcgatttagtctgacgtcaaagggaaagggggcaggagtcagtctcagtcaggacacagcgtggacatgagggtccccgctcagctcctggggctccttctactctggctccgaggtgccagatgtgacatccagatgacccagtctccatcctccctgtctgcatctgtgggagacagaatcagcatcacttgccgggcaagtcaggccattgacacccttttaaattggtatcagcagaagccagggaaagcccctaaacttctgatctatgatgcaaccaatttacaagatgggatcccatcaaggttcagtggcggtggatctggggcggatttcactctcaccatcagcagtctgcaacctgaagattttgcgacttactggtgtcaacgagggttatcataacccgtacacttttggccaggggaccaagctggacatcaatacgaactgtggctgcaccatctgtt

SEQ ID NO: 584890 - DNA, 490 bp, Homo sapiens; identical to SEQ ID NO: 543909
  misc_feature: HIJSMM301AOCQ0.14.55.E11.1.454.light.4.raw

SEQ ID NO: 584891 - DNA, 493 bp, Homo sapiens; identical to SEQ ID NO: 537422
  misc_feature: HIJSMM301EZH2R.9.34.D01.1.454.light.4.raw

SEQ ID NO: 584892 - DNA, 485 bp, Homo sapiens
  misc_feature: HIJSMM301EE1ZF.48.70.G04.1.454.light.4.raw
agtatacatacacgaccggtgctcgatttagtgtagtgtgaagggaaaggggagagctctggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgctagtttattactgtcagcagtatgataactggcctccgttcaccttcggcggcgggaccaaggtggagatcaaacgaa

SEQ ID NO: 584893 - DNA, 518 bp, Homo sapiens
  misc_feature: HIJSMM301DCQG2.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcaccgcagcagcggcagcattggcagcagctatgtgcagtggttccagcagcgcccgggcagttctcccgtcactctaatttatgaagattttcgaagactcctggggtccctttcggttttctggctccatcgacagtccctccaactccgcctcccttaccatatctgggctgaagagtgaggacgaggctgactacttctgtcagtcttatgatataaacaattatgtgataattggcggagggaccaggtgaccgtcctaggtcagcccaaggctcgccccctcggtccactctcgttcccta

SEQ ID NO: 584894 - DNA, 505 bp, Homo sapiens; identical to SEQ ID NO: 542754
  misc_feature: HIJSMM301EDS9E.4.57.F02.1.454.light.4.raw

SEQ ID NO: 584895 - DNA, 491 bp, Homo sapiens
  misc_feature: HIJSMM301EJGUT.48.38.D05.1.454.light.4.raw
agtatacatacacgaccggtgctcgatttagtatctgatagttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccggcagaagacgaggctgactactattgtcagtcaggagacaatactcgcacgcaagtactgttcggcggagggaccaagctgacagtcctaggtcagcccaaggctgccccccg

SEQ ID NO: 584896 - DNA, 503 bp, Homo sapiens; identical to SEQ ID NO: 547049
  misc_feature: HIJSMM301AEPIA.18.59.F04.1.454.light.4.raw

SEQ ID NO: 584897 - DNA, 496 bp, Homo sapiens
  misc_feature: HIJSMM301BCLEH.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggcctgccccctggtcactctgttcccaccctcct

SEQ ID NO: 584898 - DNA, 487 bp, Homo sapiens
  misc_feature: HIJSMM301AMUR8.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgcttgaaaatcagtagggtggaggctgaggatgttggggtttattactgcatgcaagttctacaacttcctacacttttggccaggggaccaagctggagatcaaacgaa

SEQ ID NO: 584899 - DNA, 500 bp, Homo sapiens
  misc_feature: HIJSMM301A8MCF.49.35.D02.1.454.light.4.raw
agtcgagagacacgaccggtgctcgatttagcacacgatagttgggtttggggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataatgtccgggctccggacacttcggtcggagggaccgaacggtaggaggagtacaaacgaacgtaagtaggcgtgcacca

SEQ ID NO: 584900 - DNA, 489 bp, Homo sapiens; identical to SEQ ID NO: 542052
  misc_feature: HIJSMM301EC6OS.10.77.G11.1.454.light.4.raw

SEQ ID NO: 584901 - DNA, 503 bp, Homo sapiens
  misc_feature: HIJSMM301DMFHR.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaatagaggtcaaacgaactgtggctgcaccatctgtcttcattcc

SEQ ID NO: 584902 - DNA, 483 bp, Homo sapiens; identical to SEQ ID NO: 535413
  misc_feature: HIJSMM301CQ3UO.26.78.H01.1.454.light.4.raw

SEQ ID NO: 584903 - DNA, 501 bp, Homo sapiens
  misc_feature: HIJSMM301AG8IU.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgtactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccctc

SEQ ID NO: 584904 - DNA, 490 bp, Homo sapiens; identical to SEQ ID NO: 558441
  misc_feature: HIJSMM301B4ACF.43.33.C11.1.454.light.4.raw

SEQ ID NO: 584905 - DNA, 501 bp, Homo sapiens
  misc_feature: HIJSMM301C2ZGN.19.78.H01.1.454.light.4.raw
  modified_base (497)..(497): a, c, t, g, unknown or other
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcacgtcctaggtcagccaaggcaacccacngtca

SEQ ID NO: 584906 - DNA, 495 bp, Homo sapiens; identical to SEQ ID NO: 535596
  misc_feature: HIJSMM301CCY4T.10.79.H02.1.454.light.4.raw

SEQ ID NO: 584907 - DNA, 495 bp, Homo sapiens; identical to SEQ ID NO: 538269
  misc_feature: HIJSMM301BPZOM.9.1.A01.1.454.light.4.raw

SEQ ID NO: 584908 - DNA, 521 bp, Homo sapiens; identical to SEQ ID NO: 538715
  misc_feature: HIJSMM301BKN3B.27.23.C01.1.454.light.4.raw

SEQ ID NO: 584909 - DNA, 494 bp, Homo sapiens
  misc_feature: HIJSMM301CO1SZ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctggggacagacttcactctcaccatcagcagactggagcctgaggattttgcagtgtattactgtcagcagtatcataggtcaaacaccttcggccaagggacacgactggagattaaggaactgtggctgcaccatctgtcttcatcttccccg

SEQ ID NO: 584910 - DNA, 486 bp, Homo sapiens
  misc_feature: HIJSMM301DPE8J.14.53.E09.1.454.light.4.raw
  modified_base (463)..(463): a, c, t, g, unknown or other
cgtctagtaccacgaccggtgctcgatttagagagagtgtgttgggtttgggggggaggcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgtctttttggtaccagcagaagccaggccacggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattctatcggtgttcggnggaggaccaagctgaccgtccta

SEQ ID NO: 584911 - DNA, 494 bp, Homo sapiens; identical to SEQ ID NO: 534994
  misc_feature: HIJSMM301DLIWY.27.78.H01.1.454.light.4.raw

SEQ ID NO: 584912 - DNA, 486 bp, Homo sapiens; identical to SEQ ID NO: 535917
  misc_feature: HIJSMM301BZGU8.3.10.A10.1.454.light.4.raw

SEQ ID NO: 584913 - DNA, 503 bp, Homo sapiens; identical to SEQ ID NO: 575244
  misc_feature: HIJSMM301B4CA8.10.71.G05.1.454.light.4.raw

SEQ ID NO: 584914 - DNA, 497 bp, Homo sapiens; identical to SEQ ID NO: 534982
  misc_feature: HIJSMM301DKO31.26.80.H03.1.454.light.4.raw

SEQ ID NO: 584915 - DNA, 514 bp, Homo sapiens; identical to SEQ ID NO: 544242
  misc_feature: HIJSMM301CCQ29.43.23.C01.1.454.light.4.raw

SEQ ID NO: 584916 - DNA, 444 bp, Homo sapiens
  misc_feature: HIJSMM301BZ5ZD.10.27.C05.1.454.light.4.raw
catagtagtgcacgaccggtgctcgatttagacgcgatcgaagggtcctgggccctgtctgccctgactcagcctgcctccgtgtctgggtctcctggacagtcggtcaccatctcctgcactggacccagcactgatgttgggcattataaccttgtctcctggtatcaacaacgcccagacaaagcccccacactcttgatttatgaagtcagtaagcggccctcaggagtttctagtcgcttctctgcctccaagtctggcaacacggcctccctgacaatctctgggctccaggctgacgacgaggctgaatattactgcagctcatatgtagatggtgcctctttcaaggttttcggcggagggaccaggctgaccgtcctaagtcagcccaaggctgccccctcggtcactctgttcccgccctcctccactactatg

SEQ ID NO: 584917 - DNA, 495 bp, Homo sapiens; identical to SEQ ID NO: 537415
  misc_feature: HIJSMM301CJLR2.4.27.C05.1.454.light.4.raw

SEQ ID NO: 584918 - DNA, 377 bp, Homo sapiens; identical to SEQ ID NO: 536071
  misc_feature: HIJSMM301BGC9U.40.9.A09.1.454.light.4.raw

SEQ ID NO: 584919 - DNA, 498 bp, Homo sapiens
  misc_feature: HIJSMM301A2WDK.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaattttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctcccgtacacttttggccaggggaccaagctggagatcaaacgaactgtggctgcaccatctgtcttca

SEQ ID NO: 584920 - DNA, 489 bp, Homo sapiens; identical to SEQ ID NO: 536013
  misc_feature: HIJSMM301CZUT3.26.23.C01.1.454.light.4.raw

SEQ ID NO: 584921 - DNA, 485 bp, Homo sapiens; identical to SEQ ID NO: 546308
  misc_feature: HIJSMM301AV5XL.47.60.F05.1.454.light.4.raw

SEQ ID NO: 584922 - DNA, 503 bp, Homo sapiens; identical to SEQ ID NO: 549042
  misc_feature: HIJSMM301DV6HY.2.35.D02.1.454.light.4.raw

SEQ ID NO: 584923 - DNA, 481 bp, Homo sapiens
  misc_feature: HIJSMM301D1JD1.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttatactgtctccagtatgatgcttaccctcggactttcggccaaggaccaaggtggaatcaaacgaactagtggctgcacta

SEQ ID NO: 584924 - DNA, 447 bp, Homo sapiens; identical to SEQ ID NO: 535201
  misc_feature: HIJSMM301CUE8G.18.9.A09.1.454.light.4.raw

SEQ ID NO: 584925 - DNA, 505 bp, Homo sapiens
  misc_feature: HIJSMM301DCA3C.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagtattttgctagtttattactgtcaacatcgtaccgagtggcctccggggccacttcggccctgggaccaaattgagatacaaacgaactgtggcgtgcaccatctgtcttcatcttcccgcc

SEQ ID NO: 584926 - DNA, 501 bp, Homo sapiens
  misc_feature: HIJSMM301A6U2C.19.78.H01.1.454.light.4.raw
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactgtcactctgttcccaccctcctccacgagagta

SEQ ID NO: 584927 - DNA, 490 bp, Homo sapiens; identical to SEQ ID NO: 543909
  misc_feature: HIJSMM301CEFWL.14.55.E11.1.454.light.4.raw

SEQ ID NO: 584928 - DNA, 512 bp, Homo sapiens
  misc_feature: HIJSMM301BQL1F.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatacaaaaaatatgtttattggtaccaacagaagtcaggccaggcccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtcctaggtcagcccaaggctgccccctggtcactctgttcccacctcct

SEQ ID NO: 584929 - DNA, 486 bp, Homo sapiens; identical to SEQ ID NO: 535043
  misc_feature: HIJSMM301AF7MF.46.35.D02.1.454.light.4.raw

SEQ ID NO: 584930 - DNA, 498 bp, Homo sapiens
  misc_feature: HIJSMM301B77VR.15.83.H06.1.454.light.4.raw
tctacgtagccacgaccggtgctcgatttagatcacgtgcgtcgcgggggcaggagtcagtctcagtcaggacacagcatggacatgagggtccccgctcagctcctggggctcctgctactctggctccgaggagccaaatgtgacatccagatgacccagtctccatcctccctgtctgcatctgtaggagacagaatcaccatcacttgccggtcaagtcagaacattaggaattatttaaattggtatcagcagaaaccagggaaagcccctaagctcctgatctatggtgcatccagtttgcaaagtggggcccatcaaggttcagtggcagtggctctgggacagatttcactctcaccatcagcagtctccaacctgaagattttgcaactttactactgtcaacagagtttccagtagtccccggacgtcggtccacggaccaaggtcggacatactaacgaactacgtggctgtcaccactcctgtctt

SEQ ID NO: 584931 - DNA, 488 bp, Homo sapiens; identical to SEQ ID NO: 541987
  misc_feature: HIJSMM301A795L.8.12.B01.1.454.light.4.raw

SEQ ID NO: 584932 - DNA, 513 bp, Homo sapiens
  misc_feature: HIJSMM301D6NZ8.52.34.D01.1.454.light.4.raw
cgcagtacgacacgaccggtgctcgatttagatcgtctgtgttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagccccaaactcatcatttttgaggtcactaagcggccctcaggggtccctgatcgcttctctggctcgaagtctggcaacacggcctccctgaccgtctctgggctccaggctgaggatgaggctgattactactgcacctcatatgcaggcacaacaatttgggggttttcgcggagggaccaaggtgaccgtcctacgtcagcccaaggctgccccctggtcactctgttcccc

SEQ ID NO: 584933 - DNA, 493 bp, Homo sapiens; identical to SEQ ID NO: 560592
  misc_feature: HIJSMM301B5LEK.12.38.D05.1.454.light.4.raw

SEQ ID NO: 584934 - DNA, 497 bp, Homo sapiens
  misc_feature: HIJSMM301BUVUJ.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccaggggaccgaaggtggagagtacaaacgaactgtggctgcaccatctgtcttcatcttcccg

SEQ ID NO: 584935 - DNA, 505 bp, Homo sapiens
  misc_feature: HIJSMM301E2KP9.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattattacttacgttggacgtcggtccgacggacggaacggaggtagtagtatacagacaacgtggtcgt

SEQ ID NO: 584936 - DNA, 492 bp, Homo sapiens; identical to SEQ ID NO: 536175
  misc_feature: HIJSMM301D93RW.19.83.H06.1.454.light.4.raw

SEQ ID NO: 584937 - DNA, 501 bp, Homo sapiens; identical to SEQ ID NO: 568432
  misc_feature: HIJSMM301AHAAE.2.49.E05.1.454.light.4.raw

SEQ ID NO: 584938 - DNA, 483 bp, Homo sapiens
  misc_feature: HIJSMM301CV2LK.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgcaacaatataatagttattggacgttcggccaggggaccaaggtcgaaatgagacgaactgtggctgcaccatctgtctt

SEQ ID NO: 584939 - DNA, 502 bp, Homo sapiens
  misc_feature: HIJSMM301BM0GO.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggcccaaccccactg

SEQ ID NO: 584940 - DNA, 473 bp, Homo sapiens
  misc_feature: HIJSMM301AGBFO.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctactttggcggggggaccgaaggtggacatcaaacgaa

SEQ ID NO: 584941 - DNA, 502 bp, Homo sapiens; identical to SEQ ID NO: 536253
  misc_feature: HIJSMM301BBNKW.21.22.B11.1.454.light.4.raw

SEQ ID NO: 584942 - DNA, 506 bp, Homo sapiens
  misc_feature: HIJSMM301CIMP0.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctcgggggccactttcggccctgggaccaaagtaggatatacaaacgaactgtggctgcaccatctgtctt

SEQ ID NO: 584943 - DNA, 496 bp, Homo sapiens
  misc_feature: HIJSMM301AN749.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccgaaggtggagttcaaacgaactgtggctgcaccatctgtcttcatcc

SEQ ID NO: 584944 - DNA, 483 bp, Homo sapiens
  misc_feature: HIJSMM301CDTTY.3.88.H11.1.454.light.4.raw
  modified_base (479)..(479): a, c, t, g, unknown or other
agacgcactccacgaccggtgctcgatttagcgacagcgagaacacacaaaggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagattttgcaacttactattgtcaacaggctaacagtttcccttaatcttcggccaagggacacgactggagattaaacgaactgtggctgnacca

SEQ ID NO: 584945 - DNA, 507 bp, Homo sapiens
  misc_feature: HIJSMM301CD928.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaatagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcta

SEQ ID NO: 584946 - DNA, 464 bp, Homo sapiens; identical to SEQ ID NO: 537111
  misc_feature: HIJSMM301AFMBW.17.28.C06.1.454.light.4.raw

SEQ ID NO: 584947 - DNA, 501 bp, Homo sapiens; identical to SEQ ID NO: 536142
  misc_feature: HIJSMM301CBJZ8.15.1.A01.1.454.light.4.raw

SEQ ID NO: 584948 - DNA, 492 bp, Homo sapiens
  misc_feature: HIJSMM301CPGX5.17.21.B10.1.454.light.4.raw
cgtagactagcacgaccggtgctcgatttagtgtcgtcgcaagggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcaacttttggccaggggaccaaactggatatcagacgaactgtggctgca

SEQ ID NO: 584949 - DNA, 486 bp, Homo sapiens
  misc_feature: HIJSMM301EHJK3.4.39.D06.1.454.light.4.raw
agcactgtagcacgaccggtgctcgatttagtgacatctcgcagttctttgggggagtcagactcagtcaggacacagcatggacatgagggtcccccgctcagctcctggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccgaggggaccgaaggtacgaaatgagacgaactgtgctgcaccatc

SEQ ID NO: 584950 - DNA, 515 bp, Homo sapiens
  misc_feature: HIJSMM301AUA1P.49.11.A11.1.454.light.4.raw
  modified_base (500)..(500): a, c, t, g, unknown or other
agtcgagagacacgaccggtgctcgatttagctacgactgcaggggctgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccnccctcctctctctcg

SEQ ID NO: 584951 - DNA, 499 bp, Homo sapiens
  misc_feature: HIJSMM301AY4TM.10.9.A09.1.454.light.4.raw
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccacttcggccctgggaccaagtggagatcaacgaactagtggctgcacca

SEQ ID NO: 584952 - DNA, 447 bp, Homo sapiens; identical to SEQ ID NO: 535020
  misc_feature: HIJSMM301AQVSA.18.9.A09.1.454.light.4.raw

SEQ ID NO: 584953 - DNA, 437 bp, Homo sapiens
  misc_feature: HIJSMM301D8PT1.13.73.G07.1.454.light.4.raw
tcacgtactacacgaccggtgctcgatttagctctacgctcagggtcctgggcccagtctgccctgactcagcctgcctccgtgtctgggtctcctggacagtcgatcaccatctcctgcactggaaacagcagtgatcttgggacttatagacttgtctcctggtaccaacaccacccaggcaaggcccccagagtcatcatttatgggggcaataggcggccgtcagggatttccactcgcttctctggctccaagtctggcaacacggcctccctgacaatctctggtctccaggctgaggacgaggctgcctattactgctgctcatatgcaggttcttctgtggtcttcggcggagggtccaaagtgaccgtcctaggtcagcccaaggctgccccctcggtcactctgttcccgcctcctctagtacgtga

SEQ ID NO: 584954 - DNA, 515 bp, Homo sapiens
  misc_feature: HIJSMM301A4KQO.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaacggtaggaaagtacaaaacgaacctagtggcgtgcgaccactctcgtcttctatcttccccg

SEQ ID NO: 584955 - DNA, 469 bp, Homo sapiens
  misc_feature: HIJSMM301D50D0.13.39.D06.1.454.light.4.raw
tcacgtactacacgaccggtgctcgatttagtgacatctcgcagttctttggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcactgcccgctatgtcttcggaactggaccaaggtcaccgtct

SEQ ID NO: 584956 - DNA, 486 bp, Homo sapiens; identical to SEQ ID NO: 537428
  misc_feature: HIJSMM301BV9IU.47.62.F07.1.454.light.4.raw

SEQ ID NO: 584957 - DNA, 495 bp, Homo sapiens
  misc_feature: HIJSMM301CACP9.11.71.G05.1.454.light.4.raw
cgagagataccacgaccggtgctcgatttagtgtcgtcgcaagagagaggggggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaattaaacgaactgtggctgcaccatctgtctttatcttccg

SEQ ID NO: 584958 - DNA, 488 bp, Homo sapiens; identical to SEQ ID NO: 538179
  misc_feature: HIJSMM301EAS03.7.85.H08.1.454.light.4.raw

SEQ ID NO: 584959 - DNA, 496 bp, Homo sapiens; identical to SEQ ID NO: 535541
  misc_feature: HIJSMM301ERUOP.3.33.C11.1.454.light.4.raw

SEQ ID NO: 584960 - DNA, 481 bp, Homo sapiens
  misc_feature: HIJSMM301CR6V1.43.63.F08.1.454.light.4.raw
tgtgagtagtcacgaccggtgctcgatttagcgatcgtataagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcaccta

SEQ ID NO: 584961 - DNA, 504 bp, Homo sapiens
  misc_feature: HIJSMM301D6U4C.52.38.D05.1.454.light.4.raw
cgcagtacgacacgaccggtgctcgatttagtatctgatagttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgagggctgactattattgtcaatcaacagacaccattggtacttatgtcttcggaactgcgaccaaggtcaccgtcctgggtcacgacccaaggacccaacccactcgtcactccg

SEQ ID NO: 584962 - DNA, 444 bp, Homo sapiens; identical to SEQ ID NO: 536096
  misc_feature: HIJSMM301AY0LC.7.18.B07.1.454.light.4.raw

SEQ ID NO: 584963 - DNA, 504 bp, Homo sapiens
  misc_feature: HIJSMM301A6KIL.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaaggtcaaacgaactgtggctgcaccatctgtcttcatt

SEQ ID NO: 584964 - DNA, 485 bp, Homo sapiens; identical to SEQ ID NO: 542735
  misc_feature: HIJSMM301BRKQ1.26.45.E01.1.454.light.4.raw

SEQ ID NO: 584965 - DNA, 469 bp, Homo sapiens; identical to SEQ ID NO: 536091
  misc_feature: HIJSMM301EOZCG.3.82.H05.1.454.light.4.raw

SEQ ID NO: 584966 - DNA, 524 bp, Homo sapiens
  misc_feature: HIJSMM301A75KD.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctcgccccctccggtcacctctgttcccgccct

SEQ ID NO: 584967 - DNA, 507 bp, Homo sapiens; identical to SEQ ID NO: 535641
  misc_feature: HIJSMM301C6VCI.10.88.H11.1.454.light.4.raw

SEQ ID NO: 584968 - DNA, 503 bp, Homo sapiens; identical to SEQ ID NO: 538884
  misc_feature: HIJSMM301CWN49.27.78.H01.1.454.light.4.raw

SEQ ID NO: 584969 - DNA, 491 bp, Homo sapiens
  misc_feature: HIJSMM301DHUQS.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaacgcccctaacctcctcatctctactgcatccactttgcaaagtggggtcccatcaaggttcagcggcagtggatctgggacagatttcactctcactatcagcagcctgcagcctgaagtattttggaacttattattgtcaacagggtaacagtttcccgctcaccttcggcggagggaccaaggtggagatgaaaagaactgtggctgcaccat

SEQ ID NO: 584970 - DNA, 494 bp, Homo sapiens; identical to SEQ ID NO: 534992
  misc_feature: HIJSMM301CHD11.9.1.A01.1.454.light.4.raw

SEQ ID NO: 584971 - DNA, 513 bp, Homo sapiens
  misc_feature: HIJSMM301DTKQ1.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcaggtggcagtgggtctgggacagagttcactctcaccatcagcagcctgcagtctgaagtattttgctagtttattattgtcagcagtataataactggcctccgtggacggttcggccgaagggaccgaaggtaggaaatacaaaacgaactggtggcgtcgcgaccatctgttcttcta

SEQ ID NO: 584972 - DNA, 474 bp, Homo sapiens; identical to SEQ ID NO: 574104
  misc_feature: HIJSMM301DXMHB.52.59.F04.1.454.light.4.raw

SEQ ID NO: 584973 - DNA, 465 bp, Homo sapiens
  misc_feature: HIJSMM301DQWE7.18.9.A09.1.454.light.4.raw
  modified_base (447)..(447): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactaggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccctccctcctcactctactnagcggcgtgcgagacgcg

SEQ ID NO: 584974 - DNA, 497 bp, Homo sapiens
  misc_feature: HIJSMM301BC2E2.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctacttcttttctcttcggaactgggaccacggtcaccgtcctaggtcagcccaaggcccaaccca

SEQ ID NO: 584975 - DNA, 492 bp, Homo sapiens
  misc_feature: HIJSMM301D19L8.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttaaagaactccaacaatcagaattacttaacttggtatcagcagaaagcaggccagcctcccaagttgctcatttactgggcatcaacccgggaatccggggtccctgaccgattcagtggcagcgggtctgggacagacttcactctcaccatcagcagcctgcaggctgaagatgtggcagtttattactgtcagcagtattatagtactcctccgacgttcggccaagggaccaaggtggagattaaacgaactgtggctgcaccatctgtcttcatcttcccgccat

SEQ ID NO: 584976 - DNA, 508 bp, Homo sapiens; identical to SEQ ID NO: 536388
  misc_feature: HIJSMM301BXFJK.11.57.F02.1.454.light.4.raw

SEQ ID NO: 584977 - DNA, 485 bp, Homo sapiens; identical to SEQ ID NO: 541838
  misc_feature: HIJSMM301EKEST.22.6.A06.1.454.light.4.raw

SEQ ID NO: 584978 - DNA, 493 bp, Homo sapiens
  misc_feature: HIJSMM301ER0IM.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatcccggggtccctgaccgattcagtggcagcgggtctggcacagatttcactctcaccatcagcagcctgcaggctgaagatgtggcagtttattactgtcagcaatatgaaagtattccttttactttcggccctgggaccaaagtggatatcaaacgaactgtggctgcaccat

SEQ ID NO: 584979 - DNA, 444 bp, Homo sapiens; identical to SEQ ID NO: 554352
  misc_feature: HIJSMM301B01GB.5.9.A09.1.454.light.4.raw

SEQ ID NO: 584980 - DNA, 502 bp, Homo sapiens; identical to SEQ ID NO: 540196
  misc_feature: HIJSMM301AN7V8.40.45.E01.1.454.light.4.raw

SEQ ID NO: 584981 - DNA, 487 bp, Homo sapiens
  misc_feature: HIJSMM301DLGDK.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccaagggaccgaaggtaggaaagtacaaacgaaactagtgggctgcacca

SEQ ID NO: 584982 - DNA, 473 bp, Homo sapiens
  misc_feature: HIJSMM301DHR0G.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaagggaccaaggtggaatacaaacgaa

SEQ ID NO: 584983 - DNA, 496 bp, Homo sapiens
  misc_feature: HIJSMM301BNZUB.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgcaa

SEQ ID NO: 584984 - DNA, 479 bp, Homo sapiens
  misc_feature: HIJSMM301B2LD0.48.37.D04.1.454.light.4.raw
agtatacatacacgaccggtgctcgatttagtagcatactgttgggtttggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagtgggacccaggctatggatgaggctgactattactgtcaggcgtgggacatcagcagtgaggtggttttcggcggagggaccaagctgaccgtcctaagtcagcccaac

SEQ ID NO: 584985 - DNA, 483 bp, Homo sapiens; identical to SEQ ID NO: 535413
  misc_feature: HIJSMM301D7AGZ.26.78.H01.1.454.light.4.raw

SEQ ID NO: 584986 - DNA, 383 bp, Homo sapiens; identical to SEQ ID NO: 447524
  misc_feature: HIJSMM301DEVT0.41.26.C04.1.454.light.4.raw

SEQ ID NO: 584987 - DNA, 511 bp, Homo sapiens
  misc_feature: HIJSMM301A2OTC.43.78.H01.1.454.light.4.raw
tgtgagtagtcacgaccggtgctcgatttagtgtgagtagtttgggtttgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccgactggcatcccagacaggttcagtggcagtgggtcgtgggacgagacttcactctcaccgtcagcagactggaccctgaagattttgtcagtgtattactgtcagcagtatggtagctcaccgatcaccttcggccaagggacacgactggagattaaccgaactgtggctgcaccatctgtcttcatcttccccg

SEQ ID NO: 584988 - DNA, 493 bp, Homo sapiens; identical to SEQ ID NO: 537422
  misc_feature: HIJSMM301B6XP6.9.34.D01.1.454.light.4.raw

SEQ ID NO: 584989 - DNA, 474 bp, Homo sapiens
  misc_feature: HIJSMM301B1RPH.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaaagtattttgctagtttattactgtcagcaatataacaagtggccattcactttcggcccacggaccaaagtggatatcaaacgaactgtggctgcaccatctgtcttcatcttccgccat

SEQ ID NO: 584990 - DNA, 487 bp, Homo sapiens; identical to SEQ ID NO: 543166
  misc_feature: HIJSMM301DC6RM.5.23.C01.1.454.light.4.raw

SEQ ID NO: 584991 - DNA, 511 bp, Homo sapiens; identical to SEQ ID NO: 545382
  misc_feature: HIJSMM301CX778.15.34.D01.1.454.light.4.raw

SEQ ID NO: 584992 - DNA, 495 bp, Homo sapiens; identical to SEQ ID NO: 535596
  misc_feature: HIJSMM301BKHHS.10.79.H02.1.454.light.4.raw

SEQ ID NO: 584993 - DNA, 444 bp, Homo sapiens; identical to SEQ ID NO: 534993
  misc_feature: HIJSMM301ARAWP.5.9.A09.1.454.light.4.raw

SEQ ID NO: 584994 - DNA, 495 bp, Homo sapiens
  misc_feature: HIJSMM301BXAYO.41.53.E09.1.454.light.4.raw
tctatactatcacgaccggtgctcgatttagagagagtgtgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctggaggacgaggctgattattactgcagctcatatacaagcagcagcactctcgtggtattcggcggaggaccaagctgaccgtcctaggtcagcccaa

SEQ ID NO: 584995 - DNA, 471 bp, Homo sapiens
  misc_feature: HIJSMM301APT6J.49.75.G09.1.454.light.4.raw
  modified_base (221)..(221): a, c, t, g, unknown or other
agtcgagagacacgaccggtgctcgatttagtatagacatcaggggggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccngggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcgggggaccgaaggtggagagtcaagcgaactgtggctgcaccatctgtcttcatcttcccgccatctgatctc

SEQ ID NO: 584996 - DNA, 478 bp, Homo sapiens
  misc_feature: HIJSMM301CCH2W.5.73.G07.1.454.light.4.raw
atcagacacgcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccgccctgtctgtgtctccaggggaaagagcctccctctcgtgcagggccagtcagagtgttagaatcaacttagcctggtaccagcagaaacctggccagcctcccaggcccctcatctatgctgcatccgccagggccactggtatcccagccaggttcagtggcagtgggtctgggacagacttcactctcaccatcagcagcctgcagtctgaagattttgcagtttatactgtcagcagtatgatgactggcctcagacgttcggccaagggaccaaggtggaagtcaaacgaactgtggctgcaccat

SEQ ID NO: 584997 - DNA, 498 bp, Homo sapiens; identical to SEQ ID NO: 537020
  misc_feature: HIJSMM301D2BKL.26.26.C04.1.454.light.4.raw

SEQ ID NO: 584998 - DNA, 518 bp, Homo sapiens; identical to SEQ ID NO: 539372
  misc_feature: HIJSMM301C0XZ1.7.86.H09.1.454.light.4.raw

SEQ ID NO: 584999 - DNA, 507 bp, Homo sapiens
  misc_feature: HIJSMM301D7ZVC.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggcccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggaggaccaggctgaccgtcctaagtcagcccaaggctgccccctc

SEQ ID NO: 585000 - DNA, 505 bp, Homo sapiens
  misc_feature: HIJSMM301B1YPX.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcccacccttccc

SEQ ID NO: 585001 - DNA, 488 bp, Homo sapiens; identical to SEQ ID NO: 541987
  misc_feature: HIJSMM301BEL3R.8.12.B01.1.454.light.4.raw

SEQ ID NO: 585002 - DNA, 520 bp, Homo sapiens
  misc_feature: HIJSMM301BMIDF.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccgggatgaggccgactattactgtcaggtgtggaatggtgattatgattatgtcttcggaactgggaccaaggtcaccgtcctaggtcagcccaaggcccaacccactgtcactctcgttcccaccctcctccgtcgt

SEQ ID NO: 585003 - DNA, 504 bp, Homo sapiens
  misc_feature: HIJSMM301EJBHM.12.53.E09.1.454.light.4.raw
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggccctcaggggtttcttatcgcttctctggctccgagtctggcaacacggctccctgacaatctctgggctccaggctgaggacgaggcggattattactgttgctcatatgcgggtagtagcactttcgatgtcctattcggcggagggaccaagctgaccgtcctgggtcagcccaaggctgccccctcggtcactctgttcccgccctcctctacgtcgtat

SEQ ID NO: 585004 - DNA, 494 bp, Homo sapiens; identical to SEQ ID NO: 534992
  misc_feature: HIJSMM301AO4OD.9.1.A01.1.454.light.4.raw

SEQ ID NO: 585005 - DNA, 509 bp, Homo sapiens; identical to SEQ ID NO: 553073
  misc_feature: HIJSMM301AQ3ER.16.1.A01.1.454.light.4.raw

SEQ ID NO: 585006 - DNA, 502 bp, Homo sapiens
  misc_feature: HIJSMM301AJMTM.19.78.H01.1.454.light.4.raw
tactctcgtgcacgaccggtgctcgatttagtgtgagtagtttgggtttgggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaacgcccccaaactcatcatttatgatgccactaagcggccctcagggtttctaatcgcttctctggctccaagtctggcaacacggcctccctgacaatctctgggctccaggctgaggacgaggctgattactactgctgctcatatgcaggtcatatctcttatgtcttcggaactgggaccaaggtcaccgtcctaggtcagcccaaggcccaaccccactgt

SEQ ID NO: 585007 - DNA, 484 bp, Homo sapiens; identical to SEQ ID NO: 548960
  misc_feature: HIJSMM301C1PWJ.52.53.E09.1.454.light.4.raw

SEQ ID NO: 585008 - DNA, 486 bp, Homo sapiens; identical to SEQ ID NO: 563598
  misc_feature: HIJSMM301BVJ01.14.53.E09.1.454.light.4.raw

SEQ ID NO: 585009 - DNA, 503 bp, Homo sapiens
  misc_feature: HIJSMM301DPMH6.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacggcttccctgaccatcactggggctcaggcggaagatgaggctgactattactgtaactcccgggacagcagtgctgaccaggtggtattcggcggagggacccacctgaccgtcttaggtcagcccaaggctgccccctcggtcact

SEQ ID NO: 585010 - DNA, 447 bp, Homo sapiens; identical to SEQ ID NO: 535020
  misc_feature: HIJSMM301CK3SZ.18.9.A09.1.454.light.4.raw

SEQ ID NO: 585011 - DNA, 505 bp, Homo sapiens; identical to SEQ ID NO: 546412
  misc_feature: HIJSMM301DKOZ0.22.21.B10.1.454.light.4.raw

SEQ ID NO: 585012 - DNA, 515 bp, Homo sapiens; identical to SEQ ID NO: 556262
  misc_feature: HIJSMM301AK91Q.40.27.C05.1.454.light.4.raw

SEQ ID NO: 585013 - DNA, 447 bp, Homo sapiens
  misc_feature: HIJSMM301C9FPM.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggccaacccctctgtcactctcgttcccaccctcctccatactcgta

SEQ ID NO: 585014 - DNA, 521 bp, Homo sapiens
  misc_feature: HIJSMM301DDIU7.53.20.B09.1.454.light.4.raw
cgcgtatacacacgaccggtgctcgatttagtgtagtgtgaagggggggcctaaggaagcagcactggtggtgcctcagccatggcctggaccgttctcctcctcggcctcctctctcactgcacaggctctgtgacctcctatgtgctgactcagccaccctcggtgtcagtggccccaggaaggacggccacgattacctgtgggggaaacaacattggaagtaaaagtgtgcactggtaccagcacaagccaggccaggcccctgcgctggtcgtctatgatgatagcgaccggccctcagggatccctgagcgattctctggctccaactctggggacacggccaccctgaccatcagcagggtcgaagccggggacgaggccgactattactgtcaggtgtgggattttaatagtgatcattgggtgttcggcggagggaccaagctgaccgtcctaggtcagcccaaggctcgccccctcggtcactctcgttcccaccctccctctctactgcg

SEQ ID NO: 585015 - DNA, 476 bp, Homo sapiens; identical to SEQ ID NO: 537368
  misc_feature: HIJSMM301DUH99.7.83.H06.1.454.light.4.raw

SEQ ID NO: 585016 - DNA, 505 bp, Homo sapiens; identical to SEQ ID NO: 536117
  misc_feature: HIJSMM301DAWZW.8.71.G05.1.454.light.4.raw

SEQ ID NO: 585017 - DNA, 452 bp, Homo sapiens
  misc_feature: HIJSMM301B9NK5.13.23.C01.1.454.light.4.raw
tcacgtactacacgaccggtgctcgatttagtacacgtgattagggattgggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccgactgaccgtcctcggtcagcccaaggctgccccatcggtcactctgttcccgccctcctctagtacgtga

SEQ ID NO: 585018 - DNA, 502 bp, Homo sapiens; identical to SEQ ID NO: 541615
  misc_feature: HIJSMM301D3Y6B.21.26.C04.1.454.light.4.raw

SEQ ID NO: 585019 - DNA, 494 bp, Homo sapiens; identical to SEQ ID NO: 535497
  misc_feature: HIJSMM301BF0O0.43.72.G06.1.454.light.4.raw

SEQ ID NO: 585020 - DNA, 478 bp, Homo sapiens
  misc_feature: HIJSMM301D879U.40.59.F04.1.454.light.4.raw
tctagcgactcacgaccggtgctcgatttagtacacacacttagggattggggtgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggtttcggcggagggaccaagctgaccgtcctaagtcagcccaac

SEQ ID NO: 585021 - DNA, 502 bp, Homo sapiens
  misc_feature: HIJSMM301CL88J.48.67.G01.1.454.light.4.raw
agtatacatacacgaccggtgctcgatttagagtatacatattgggtttggggggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactggtggctgcaccatctgtcttcatcttcccg

SEQ ID NO: 585022 - DNA, 497 bp, Homo sapiens; identical to SEQ ID NO: 567078
  misc_feature: HIJSMM301CCK9W.26.26.C04.1.454.light.4.raw

SEQ ID NO: 585023 - DNA, 488 bp, Homo sapiens
  misc_feature: HIJSMM301C70GN.52.23.C01.1.454.light.4.raw
cgcagtacgacacgaccggtgctcgatttagtacacgtgattagggattgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatctccccctcactttcggcggagggaccaaggtggagatcagacgaactgtggctgcaccta

SEQ ID NO: 585024 - DNA, 490 bp, Homo sapiens
  misc_feature: HIJSMM301DE5UD.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagaatcagacgaactgtggctgcaccatctgtcttcta

SEQ ID NO: 585025 - DNA, 499 bp, Homo sapiens
  misc_feature: HIJSMM301C89AN.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacaccggggagttttggccaggggaccaaggctggagatcaaacgaactgtggctgcaccatctgtcttcatcttccccg

SEQ ID NO: 585026 - DNA, 498 bp, Homo sapiens
  misc_feature: HIJSMM301ALFJN.52.27.C05.1.454.light.4.raw
cgcagtacgacacgaccggtgctcgatttagacgcgatcgaagggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatagttcttcggaactgcgaccaaggtcaccgtcctgggtcagcccaaggccaaccccactgtca

SEQ ID NO: 585027 - DNA, 504 bp, Homo sapiens; identical to SEQ ID NO: 535561
  misc_feature: HIJSMM301D5NYU.4.57.F02.1.454.light.4.raw

SEQ ID NO: 585028 - DNA, 491 bp, Homo sapiens; identical to SEQ ID NO: 542796
  misc_feature: HIJSMM301A5E3H.19.57.F02.1.454.light.4.raw

SEQ ID NO: 585029 - DNA, 481 bp, Homo sapiens
  misc_feature: HIJSMM301CQQ5G.41.34.D01.1.454.light.4.raw
tctatactatcacgaccggtgctcgatttagatcgtctgtgttgggtttgggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacgatcagcggcctgcagcctgatgatgtcgcaacttattactgccaacactatgatagttacccgctcactttcggcggagggaccaaggtggaggtcaagcgaactgtggctgcac

SEQ ID NO: 585030 - DNA, 479 bp, Homo sapiens; identical to SEQ ID NO: 535586
  misc_feature: HIJSMM301B2DU9.13.34.D01.1.454.light.4.raw

SEQ ID NO: 585031 - DNA, 511 bp, Homo sapiens
  misc_feature: HIJSMM301AHAH4.43.15.B04.1.454.light.4.raw
tgtgagtagtcacgaccggtgctcgatttagacagtatatatccgcgggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcaggaccagtcagagtgttagcaccaacgtggcctggtaccagcagaaacctggccaacctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaaggaccaaggtggaattcaaccgaactagtggctgcaccatctgtcttcatcttcccgcccta

SEQ ID NO: 585032 - DNA, 479 bp, Homo sapiens
  misc_feature: HIJSMM301DJWZ5.53.85.H08.1.454.light.4.raw
cgcgtatacacacgaccggtgctcgatttagtatcactcagtcgcgggggcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttatgtcttcggactgggaccaaggtcaccg

SEQ ID NO: 585033 - DNA, 490 bp, Homo sapiens; identical to SEQ ID NO: 535526
  misc_feature: HIJSMM301B3JPM.26.78.H01.1.454.light.4.raw

SEQ ID NO: 585034 - DNA, 444 bp, Homo sapiens; identical to SEQ ID NO: 535594
  misc_feature: HIJSMM301BFFS4.9.9.A09.1.454.light.4.raw

SEQ ID NO: 585035 - DNA, 495 bp, Homo sapiens; identical to SEQ ID NO: 583557
  misc_feature: HIJSMM301AFXSX.51.83.H06.1.454.light.4.raw

SEQ ID NO: 585036 - DNA, 466 bp, Homo sapiens
  misc_feature: HIJSMM301EVX8Y.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccgagggtggagatcagacgaactgtggctgcaccatctgtcttcatcttcccgccatcttgaagtatagtct

SEQ ID NO: 585037 - DNA, 484 bp, Homo sapiens; identical to SEQ ID NO: 536312
  misc_feature: HIJSMM301C0P4I.17.21.B10.1.454.light.4.raw

SEQ ID NO: 585038 - DNA, 454 bp, Homo sapiens; identical to SEQ ID NO: 535005
  misc_feature: HIJSMM301CS7FH.19.86.H09.1.454.light.4.raw

SEQ ID NO: 585039 - DNA, 503 bp, Homo sapiens
  misc_feature: HIJSMM301B70OZ.7.31.C09.1.454.light.4.raw
cgtgtctctacacgaccggtgctcgatttagacgtctcatcaaggaaggaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggcctcaggggtccctgatcgcttctctggctccaagtctggcaacacggcctccctgaccgtctctgggctccaggctgaagatgaggctgattattactgctgctcatatgcaggccgcaacaagtgatctattcggcggagggacaagctgaccgtcctaggtcagcccaaggctgccccctcc

SEQ ID NO: 585040 - DNA, 505 bp, Homo sapiens; identical to SEQ ID NO: 567023
  misc_feature: HIJSMM301CLTFU.10.27.C05.1.454.light.4.raw

SEQ ID NO: 585041 - DNA, 480 bp, Homo sapiens; identical to SEQ ID NO: 537854
  misc_feature: HIJSMM301E3VR3.41.17.B06.1.454.light.4.raw

SEQ ID NO: 585042 - DNA, 486 bp, Homo sapiens; identical to SEQ ID NO: 535290
  misc_feature: HIJSMM301BSK8L.3.12.B01.1.454.light.4.raw

SEQ ID NO: 585043 - DNA, 486 bp, Homo sapiens; identical to SEQ ID NO: 535385
  misc_feature: HIJSMM301B0KEL.19.71.G05.1.454.light.4.raw

SEQ ID NO: 585044 - DNA, 494 bp, Homo sapiens; identical to SEQ ID NO: 534994
  misc_feature: HIJSMM301BOVWV.27.78.H01.1.454.light.4.raw

SEQ ID NO: 585045 - DNA, 502 bp, Homo sapiens
  misc_feature: HIJSMM301CNIER.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgaactggtggctgcaccatctgtctt

SEQ ID NO: 585046 - DNA, 495 bp, Homo sapiens
  misc_feature: HIJSMM301B3I5I.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggcccgtcggaccgtaaac

SEQ ID NO: 585047 - DNA, 460 bp, Homo sapiens
  misc_feature: HIJSMM301BOSB2.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatggggattacaacctgagtgatcctagttgggtgttcggcggagggaccaggctgaccgtcctaggtcagcccaaggctgccccctcggtcactctgttccgccctcctcacgcgtatgt

SEQ ID NO: 585048 - DNA, 499 bp, Homo sapiens; identical to SEQ ID NO: 545732
  misc_feature: HIJSMM301BYCXJ.3.33.C11.1.454.light.4.raw

SEQ ID NO: 585049 - DNA, 490 bp, Homo sapiens
  misc_feature: HIJSMM301DI676.40.37.D04.1.454.light.4.raw
tctagcgactcacgaccggtgctcgatttagtagcatactgttgggtttgggggactgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggccctggaccgagagtggatgtcaaacgtaacg

SEQ ID NO: 585050 - DNA, 524 bp, Homo sapiens
  misc_feature: HIJSMM301BYC95.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctgaccgtcctaggtcagcccaaggctgccccctcggtccactctcgttcccgccct

SEQ ID NO: 585051 - DNA, 512 bp, Homo sapiens
  misc_feature: HIJSMM301CB74D.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggtgggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgta

SEQ ID NO: 585052 - DNA, 522 bp, Homo sapiens; identical to SEQ ID NO: 541090
  misc_feature: HIJSMM301BYN02.27.23.C01.1.454.light.4.raw

SEQ ID NO: 585053 - DNA, 508 bp, Homo sapiens
  misc_feature: HIJSMM301CKFPR.17.41.D08.1.454.light.4.raw
cgtagactagcacgaccggtgctcgatttagtcacgcgagaaagggaaaggggaagagctgctcagttaggacccagagggaaccatggaaaccccagcgcagcttctcttcctcctgctactctggctcccagataccaccggagaaattgtgttgacgcagtctccaggcaccctgtccttgtctccaggggaaacagccaccctctcctgtagggccagtcagagtgtttttaaaaactatttagcctggtaccaacagaagcctggccaggctcccaggctcctcatctatggtgcatccaccagggccactggcatcccagacaggttcagtggcggtgggtctgggacagaattcactctcaccatcaccagtctggagcctgaagattttgctctgtatcactgtcagcaatatggtggtacacccctcactttcggcggaggggccaaggtggagatcaagcgaactgtggctgcaccatctgtcttctcttcccgccat

SEQ ID NO: 585054 - DNA, 517 bp, Homo sapiens
  misc_feature: HIJSMM301A0KKU.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatccgacgggggcccaggcagatgatgaatctaattatcactgtgcgttgtatatgggttttgctatttcggtgttcggcgggaggacccgaggtgaccgtcctacgtcagcccaaggccg

SEQ ID NO: 585055 - DNA, 518 bp, Homo sapiens
  misc_feature: HIJSMM301EEGQ9.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccaccctcctccgt

SEQ ID NO: 585056 - DNA, 513 bp, Homo sapiens; identical to SEQ ID NO: 541387
  misc_feature: HIJSMM301CA7LZ.17.33.C11.1.454.light.4.raw

SEQ ID NO: 585057 - DNA, 495 bp, Homo sapiens
  misc_feature: HIJSMM301DOT51.52.34.D01.1.454.light.4.raw
cgcagtacgacacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctgggtcagcccaaggccaacccactgtcact

SEQ ID NO: 585058 - DNA, 447 bp, Homo sapiens; identical to SEQ ID NO: 535020
  misc_feature: HIJSMM301B3NPP.18.9.A09.1.454.light.4.raw

SEQ ID NO: 585059 - DNA, 472 bp, Homo sapiens
  misc_feature: HIJSMM301B5ZH0.48.5.A05.1.454.light.4.raw
agtatacatacacgaccggtgctcgatttagatagatagacagggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccagggaccaaggtggaatcaagaactgtgctgcaccat

SEQ ID NO: 585060 - DNA, 493 bp, Homo sapiens; identical to SEQ ID NO: 547772
  misc_feature: HIJSMM301CVOZM.47.64.F09.1.454.light.4.raw

SEQ ID NO: 585061 - DNA, 469 bp, Homo sapiens
  misc_feature: HIJSMM301C1E57.3.20.B09.1.454.light.4.raw
agacgcactccacgaccggtgctcgatttagtgtagtgtgaagggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcgtctatttaaattggtatcagcacaaaccagggaaagcccctaagctcctgatctatgctgaatccacgtttgcaaagtggggtcccatcaaggttcagtggcagtggatctgggacagatttcactctaaccatcagcggtctgcaacctgaagattttgcaactcactactgtcaacagagtgacagcacgcctcacactttcggcggagggaccgaaggtggagatacaaacgaa

SEQ ID NO: 585062 - DNA, 490 bp, Homo sapiens; identical to SEQ ID NO: 535526
  misc_feature: HIJSMM301C2RRW.26.78.H01.1.454.light.4.raw

SEQ ID NO: 585063 - DNA, 491 bp, Homo sapiens; identical to SEQ ID NO: 536211
  misc_feature: HIJSMM301APOU5.16.53.E09.1.454.light.4.raw

SEQ ID NO: 585064 - DNA, 501 bp, Homo sapiens
  misc_feature: HIJSMM301D6BXJ.43.55.E11.1.454.light.4.raw
  modified_base (480)..(480): a, c, t, g, unknown or other
tgtgagtagtcacgaccggtgctcgatttagcactcgcacgttgggtttggggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtaggctggttggcctggtatcagcagaaaccagggaaagcccctaggttcctgatctataaggcatctaatttagaaagtggggtcccattaaggttcagcggcagtggatctgggacagagttactctcacatcagcagcctgcagcctgatgattttgctaacttattactgccaacaatatgattcttggccgtggacgttcggccaaggaccgaacgtaggaaatacaaacgaactagtggntgcaccaatctgtcttcactt

SEQ ID NO: 585065 - DNA, 510 bp, Homo sapiens
  misc_feature: HIJSMM301BWPRE.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatggaaggagactactattgttactctccagagaaggatggtcatcagttgggtgttcgggcgggagggaccaagctgaccgtcctaagtcagccaaggctcgccccctcggtcactctcgttcccaccct

SEQ ID NO: 585066 - DNA, 487 bp, Homo sapiens; identical to SEQ ID NO: 560173
  misc_feature: HIJSMM301ETYDK.47.70.G04.1.454.light.4.raw

SEQ ID NO: 585067 - DNA, 519 bp, Homo sapiens
  misc_feature: HIJSMM301B016O.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaaggctgattatttctgcagctcatacacaaccggcaccactgtcgtggttttcggtggagggaccaagctgaccgtcctacggtcagcccaaggctgccccctccggtcact

SEQ ID NO: 585068 - DNA, 481 bp, Homo sapiens
  misc_feature: HIJSMM301EQ8P1.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagacaaaaaccaggacagcctcctaaactgctcatctcctgggcatctacccgggcacccggagtccctgaccgattcagtggcagcgggtctgggacagacttcactctcaccatcagcaacctgcaggaactgaagatgtggcagtttattactgtcagcagtattgtgaagctccgctcactttcggcggagggaccgcggtggagatcagacgaactgtggctgcaccatctgtctt

SEQ ID NO: 585069 - DNA, 485 bp, Homo sapiens; identical to SEQ ID NO: 544293
  misc_feature: HIJSMM301EEZX8.26.70.G04.1.454.light.4.raw

SEQ ID NO: 585070 - DNA, 490 bp, Homo sapiens
  misc_feature: HIJSMM301B9Z8Y.11.12.B01.1.454.light.4.raw
cgagagataccacgaccggtgctcgatttagtagtgtagattccgcggggtggaagaacctgcccagcctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcgtgggacgacagcgtggtgttcggcggagggaccagtctgaccgtcttaggtcagcccaagg

SEQ ID NO: 585071 - DNA, 510 bp, Homo sapiens
  misc_feature: HIJSMM301ENUWJ.47.55.E11.1.454.light.4.raw
agctcacgtacacgaccggtgctcgatttagcactcgcacgttggggtttggggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctaggtcagcccaaggccaaacccct

SEQ ID NO: 585072 - DNA, 480 bp, Homo sapiens
  misc_feature: HIJSMM301BRBVD.7.76.G10.1.454.light.4.raw
cgtgtctctacacgaccggtgctcgatttagtcactcatacagggggcaggagtcagacccagtcaggacacagcatggacatgagggtctccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaactgtggctgcaccta

SEQ ID NO: 585073 - DNA, 521 bp, Homo sapiens; identical to SEQ ID NO: 538715
  misc_feature: HIJSMM301A4OW8.27.23.C01.1.454.light.4.raw

SEQ ID NO: 585074 - DNA, 502 bp, Homo sapiens; identical to SEQ ID NO: 535463
  misc_feature: HIJSMM301D8VWE.43.86.H09.1.454.light.4.raw

SEQ ID NO: 585075 - DNA, 485 bp, Homo sapiens; identical to SEQ ID NO: 536263
  misc_feature: HIJSMM301B27W0.47.78.H01.1.454.light.4.raw

SEQ ID NO: 585076 - DNA, 513 bp, Homo sapiens; identical to SEQ ID NO: 561677
  misc_feature: HIJSMM301EDBNC.7.34.D01.1.454.light.4.raw

SEQ ID NO: 585077 - DNA, 510 bp, Homo sapiens
  misc_feature: HIJSMM301C8MC4.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtataaacaacaaacactcctggacccctgcccgattctcaggctccctccttgggggcaaagctgccctgacactgtctggtgtgcagcctgaggacgaggctgactattactcgctactctactttggtggtgctgtgctattcggcggagggaccaagctgaccgtcttaagtcagccaaggctcgcccctcggtcactctgttcccta

SEQ ID NO: 585078 - DNA, 501 bp, Homo sapiens
  misc_feature: HIJSMM301CG9IF.9.71.G05.1.454.light.4.raw
tgatacgtctcacgaccggtgctcgatttagtgtcgtcgcaagagagagggggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgccccctggtcactctgtcccgcctcctcacg

SEQ ID NO: 585079 - DNA, 515 bp, Homo sapiens
  misc_feature: HIJSMM301EKHUE.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaatttggtcatatgttgttcggcggagggaccaagctgaccgtcctcggtcagcccaaggctgccccctggtcactctgttcccgccctcctc

SEQ ID NO: 585080 - DNA, 490 bp, Homo sapiens
  misc_feature: HIJSMM301CPB67.14.8.A08.1.454.light.4.raw
cgtctagtaccacgaccggtgctcgatttagcatactctacagggaaccatggaaaccccagcgcagcttctcttcctcctgctactctggctcccagataccaccggagaaattgtgttggcgcagtctccaggcaccctgtctttgtctccaggggaaagagtcaccctctcctgtagggccagtcagagtgttaggagcacctacttagcctggtaccaccagaaacctggccaggctcccaggctcctcatctatggtacatccaccagggccactggcatcccagacaggttcagtggcagtgggtctgggacagacttcactctcaccatcagcagactggagcctgaagattttggagtgtattactgtcaccactatggtgaggcaccccccatcaccttcggccaagggacacgactggagattagacgaactgtggctgcaccatctgtcttcatcttcccgccatctgagtactagacg

SEQ ID NO: 585081 - DNA, 466 bp, Homo sapiens
  misc_feature: HIJSMM301EQB20.52.8.A08.1.454.light.4.raw
cgcagtacgacacgaccggtgctcgatttagcatactctacagggggaggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccaacggtgaggatcaagcgaa

SEQ ID NO: 585082 - DNA, 522 bp, Homo sapiens
  misc_feature: HIJSMM301AOATA.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgagactgattattattgtagttcatatacaaccagtgacacttgggtgttcggcggagggaccaggactgaccgtcctaggtcagcccaaggctgccccctcggtcactctgttcccacct

SEQ ID NO: 585083 - DNA, 512 bp, Homo sapiens; identical to SEQ ID NO: 570046
  misc_feature: HIJSMM301AUVJH.51.23.C01.1.454.light.4.raw

SEQ ID NO: 585084 - DNA, 506 bp, Homo sapiens; identical to SEQ ID NO: 535058
  misc_feature: HIJSMM301A68OU.17.41.D08.1.454.light.4.raw

SEQ ID NO: 585085 - DNA, 483 bp, Homo sapiens
  misc_feature: HIJSMM301D4YBK.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagattccactctcaccatcaacagtctgcaacctgaagattttgcaacttactactgtcaacagagtttcactacccctctcactttcggcgggggaccaaggtggagatcaaacgaactgtggctgcaccta

SEQ ID NO: 585086 - DNA, 512 bp, Homo sapiens
  misc_feature: HIJSMM301CBH8W.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctcgttcccta

SEQ ID NO: 585087 - DNA, 476 bp, Homo sapiens; identical to SEQ ID NO: 537812
  misc_feature: HIJSMM301DWGX8.3.82.H05.1.454.light.4.raw

SEQ ID NO: 585088 - DNA, 516 bp, Homo sapiens
  misc_feature: HIJSMM301AR0H8.21.87.H10.1.454.light.4.raw
tcgtcgctcgcacgaccggtgctcgatttagcagtactgcgttgggtttggggggggtcgacaagaggcagcgctctcgggacggtctccaccatggcctgggctctgctgctcctcactctcctcactcagggcacagggtcctgggcccgacgtctgccctgactcagcctgcctccgtgtctgggtctcccgggcagtcggtcaccatctcttgcgctggatccagcgatgatattggacgttttaaccttgtctcctggtatcaacaacaccaggacaaagccccaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggcggggacccagatgactgtcctcagtcagccccaaggccgtgcccccgtccggt

SEQ ID NO: 585089 - DNA, 486 bp, Homo sapiens; identical to SEQ ID NO: 535043
  misc_feature: HIJSMM301EXVW8.46.35.D02.1.454.light.4.raw

SEQ ID NO: 585090 - DNA, 489 bp, Homo sapiens; identical to SEQ ID NO: 536663
  misc_feature: HIJSMM301B8O7A.16.72.G06.1.454.light.4.raw

SEQ ID NO: 585091 - DNA, 473 bp, Homo sapiens
  misc_feature: HIJSMM301AITAM.52.4.A04.1.454.light.4.raw
cgcagtacgacacgaccggtgctcgatttagagtagtgatcaggggctgggcctcaggaagcagcatcggaggtgcctcagccatggcatggatccctctcttcctcggcgtccttgcttactgcacaggatgtgtggcctcctatgaggtgactcagacaccgtcagtgtccgtctccccaggacagacagccagcatcagctgttctggagataaaatggaggataaatatgtttcctggtatcgccagaagccaggccagtcgcctgtcctggtcatctatcacgataagaagcggcctcagggatccctgagcgattctctggctccaactctgggaacacagccactctgaccatcagcgggacccaggctatggatgaggctgactattactgtcagccgtgggacagaagcactctggtgttcggcggagggaccaggctgaccgtcctaggtcagcccaaggcct

SEQ ID NO: 585092 - DNA, 514 bp, Homo sapiens
  misc_feature: HIJSMM301CWG76.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccgcctcctca

SEQ ID NO: 585093 - DNA, 498 bp, Homo sapiens
  misc_feature: HIJSMM301CZF3J.19.78.H01.1.454.light.4.raw
  modified_base (465)..(465): a, c, t, g, unknown or other
tactctcgtgcacgaccggtgctcgatttagtgtgagtagtttgggtttgggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccacngtcactctgttcccaccctcctccacgagagta

SEQ ID NO: 585094 - DNA, 495 bp, Homo sapiens; identical to SEQ ID NO: 564072
  misc_feature: HIJSMM301EOSKN.11.81.H04.1.454.light.4.raw

SEQ ID NO: 585095 - DNA, 479 bp, Homo sapiens; identical to SEQ ID NO: 535188
  misc_feature: HIJSMM301AOQUJ.10.74.G08.1.454.light.4.raw

SEQ ID NO: 585096 - DNA, 488 bp, Homo sapiens
  misc_feature: HIJSMM301AWRE1.51.29.C07.1.454.light.4.raw
  modified_base (445)..(445): a, c, t, g, unknown or other
  modified_base (467)..(467): a, c, t, g, unknown or other
cgatcgtatacacgaccggtgctcgatttagagtgctacgaagggaaagggggaatcagtcccactcaggacacagcatggacatgagggtccccgctcagctcctggggctcctgctgctctggttcccaggtcccaggtgtgacatccagatgacccagtctccaccctccctgtctgcttctgtacgagacagagtcaccatcacttgccggacaagtcagggcactagaagttctttaggctcctttcagcagagaccagggaaagcccctacgcgccttaactatgttacattcagtttgcaaagtggcgtcccatcaaggtccagcggcattggatctggggcagaattcactctcacattcagcagcctgcagcctgaagatttttcaacttataagtgtctacatcataaattctttggaggagatcacacgaactntggctgcaccatctgtcttcanctttcccgccatctgatctag

SEQ ID NO: 585097 - DNA, 509 bp, Homo sapiens; identical to SEQ ID NO: 543772
  misc_feature: HIJSMM301C9VGW.2.21.B10.1.454.light.4.raw

SEQ ID NO: 585098 - DNA, 494 bp, Homo sapiens; identical to SEQ ID NO: 558889
  misc_feature: HIJSMM301AUX67.47.78.H01.1.454.light.4.raw

SEQ ID NO: 585099 - DNA, 486 bp, Homo sapiens; identical to SEQ ID NO: 536323
  misc_feature: HIJSMM301D9FY4.10.2.A02.1.454.light.4.raw

SEQ ID NO: 585100 - DNA, 472 bp, Homo sapiens; identical to SEQ ID NO: 535898
  misc_feature: HIJSMM301BNKHL.15.8.A08.1.454.light.4.raw

SEQ ID NO: 585101 - DNA, 484 bp, Homo sapiens
  misc_feature: HIJSMM301DLW5J.17.39.D06.1.454.light.4.raw
cgtagactagcacgaccggtgctcgatttagtgacatctcgcagttctttgggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttattactgtcagcagtataatcagtggcctccgtggacgttcggccaagggaccaaggtggaaatacaaacgaactgtgg

SEQ ID NO: 585102 - DNA, 504 bp, Homo sapiens
  misc_feature: HIJSMM301BT30L.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgacccgtcctagggtcagcccaa

SEQ ID NO: 585103 - DNA, 498 bp, Homo sapiens
  misc_feature: HIJSMM301AHB6X.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgtcactt

SEQ ID NO: 585104 - DNA, 504 bp, Homo sapiens
  misc_feature: HIJSMM301CL3F9.51.19.B08.1.454.light.4.raw
  modified_base (477)..(477): a, c, t, g, unknown or other
cgatcgtatacacgaccggtgctcgatttagtgagtcagtaaggggggggtcacaagaggcagcgctctcgggacgtctccaccatggcctgggctctgctgctcctcactctcctcactcaggacacaggatcctgggcccagtctgccctgactcagcctgcctccgtgtctgggtctcctggacagtccatcaccatctcatgcactggaaccagccgtgatattgggacttatcaccttgtctcctggtaccaacaacacccaggcaaagcccccaaagtcattatttatgaggccagtaggcgagcctcagggatttctagtcgcttctctgcctccgcgtctggcaacacggcctccctgacaatttctgggctccagccctgaggacgagtctcactactactgctcctcatatgcagacaatagtttcctggtgttcggcggagggaccaagttgaccgtcctaggtcngcccaagctgccccctcggtcactccg

SEQ ID NO: 585105 - DNA, 486 bp, Homo sapiens; identical to SEQ ID NO: 537127
  misc_feature: HIJSMM301EI5PE.3.77.G11.1.454.light.4.raw

SEQ ID NO: 585106 - DNA, 511 bp, Homo sapiens
  misc_feature: HIJSMM301CR53B.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggccccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccacctttcggccctgggaccaaagtggatatcaaacgaactcgtggctgcaccatctgtcttcta

SEQ ID NO: 585107 - DNA, 509 bp, Homo sapiens; identical to SEQ ID NO: 539269
  misc_feature: HIJSMM301B447K.4.57.F02.1.454.light.4.raw

SEQ ID NO: 585108 - DNA, 444 bp, Homo sapiens; identical to SEQ ID NO: 535192
  misc_feature: HIJSMM301A95WS.5.9.A09.1.454.light.4.raw

SEQ ID NO: 585109 - DNA, 481 bp, Homo sapiens
  misc_feature: HIJSMM301C5ZCO.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggagggaccaagctcgaccgtcctaagtcagaccccg

SEQ ID NO: 585110 - DNA, 495 bp, Homo sapiens; identical to SEQ ID NO: 535596
  misc_feature: HIJSMM301AVAY5.10.79.H02.1.454.light.4.raw

SEQ ID NO: 585111 - DNA, 473 bp, Homo sapiens
  misc_feature: HIJSMM301A7LEV.49.49.E05.1.454.light.4.raw
agtcgagagacacgaccggtgctcgatttagagcgactagcaacacacaagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcagtggaagtggatctgggacacattttactttcaccatcagcggcctgcagcctgaagattttgcaacatattactgtcaacagtatgaagatctcccactcactttcggcggagggaccaaggtggagatcagacgaactg

SEQ ID NO: 585112 - DNA, 496 bp, Homo sapiens
  misc_feature: HIJSMM301CZBP0.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggcagcccaaggccaa

SEQ ID NO: 585113 - DNA, 505 bp, Homo sapiens
  misc_feature: HIJSMM301ALEJ9.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggcccaacccactgtcactctgttcccaccct

SEQ ID NO: 585114 - DNA, 498 bp, Homo sapiens; identical to SEQ ID NO: 561972
  misc_feature: HIJSMM301BED6K.3.71.G05.1.454.light.4.raw

SEQ ID NO: 585115 - DNA, 491 bp, Homo sapiens
  misc_feature: HIJSMM301DSLN3.4.27.C05.1.454.light.4.raw
agcactgtagcacgaccggtgctcgatttagacgcgatcgaagggtttgggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaactgtggc

SEQ ID NO: 585116 - DNA, 505 bp, Homo sapiens; identical to SEQ ID NO: 535503
  misc_feature: HIJSMM301DKTZE.8.28.C06.1.454.light.4.raw

SEQ ID NO: 585117 - DNA, 503 bp, Homo sapiens; identical to SEQ ID NO: 570706
  misc_feature: HIJSMM301EI5YT.8.28.C06.1.454.light.4.raw

SEQ ID NO: 585118 - DNA, 513 bp, Homo sapiens
  misc_feature: HIJSMM301D3X8F.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttggtgttcggcggagggaccaggctgaccgtcctaggtcagcccaaggctgcccccc

SEQ ID NO: 585119 - DNA, 515 bp, Homo sapiens; identical to SEQ ID NO: 538805
  misc_feature: HIJSMM301C16A3.14.19.B08.1.454.light.4.raw

SEQ ID NO: 585120 - DNA, 521 bp, Homo sapiens
  misc_feature: HIJSMM301DNAIZ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtccactctcgttcccaccctcctccacg

SEQ ID NO: 585121 - DNA, 500 bp, Homo sapiens
  misc_feature: HIJSMM301DY5E1.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgccccctcggtcact

SEQ ID NO: 585122 - DNA, 470 bp, Homo sapiens
  misc_feature: HIJSMM301AKU66.52.19.B08.1.454.light.4.raw
cgcagtacgacacgaccggtgctcgatttagtgagtcagtaaggggcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccaaggtggagatcaagcgaactgtggctgcacc

SEQ ID NO: 585123 - DNA, 520 bp, Homo sapiens
  misc_feature: HIJSMM301BEJKQ.41.19.B08.1.454.light.4.raw
tctatactatcacgaccggtgctcgatttagtgagtcagtaaggggtggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcctca

SEQ ID NO: 585124 - DNA, 505 bp, Homo sapiens
  misc_feature: HIJSMM301A4RDR.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaaagctgaccgtcctaggtcagcccaaggctgccccctcggtcta

SEQ ID NO: 585125 - DNA, 444 bp, Homo sapiens; identical to SEQ ID NO: 535594
  misc_feature: HIJSMM301D8AEZ.9.9.A09.1.454.light.4.raw

SEQ ID NO: 585126 - DNA, 454 bp, Homo sapiens; identical to SEQ ID NO: 536347
  misc_feature: HIJSMM301CKU6C.19.86.H09.1.454.light.4.raw

SEQ ID NO: 585127 - DNA, 378 bp, Homo sapiens; identical to SEQ ID NO: 547290
  misc_feature: HIJSMM301CWD6K.40.9.A09.1.454.light.4.raw

SEQ ID NO: 585128 - DNA, 509 bp, Homo sapiens; identical to SEQ ID NO: 547321
  misc_feature: HIJSMM301E0JFO.4.57.F02.1.454.light.4.raw

SEQ ID NO: 585129 - DNA, 496 bp, Homo sapiens
  misc_feature: HIJSMM301BHRO0.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgtttcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcacatctgtcttcatcttccccg

SEQ ID NO: 585130 - DNA, 496 bp, Homo sapiens
  misc_feature: HIJSMM301DZKHR.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggttcgaatcgcttctctgctccaagtctggcgacacggcctccctgaccatctctgggctccaggctgaagacgaggctgattattactgcagctcatatacaggcagcagcactcaggttttcggtcggagggaccgaagctgaccgtcctaggtcagcccaaggctgccccctcggt

SEQ ID NO: 585131 - DNA, 484 bp, Homo sapiens; identical to SEQ ID NO: 540581
  misc_feature: HIJSMM301D0JQ6.3.88.H11.1.454.light.4.raw

SEQ ID NO: 585132 - DNA, 495 bp, Homo sapiens; identical to SEQ ID NO: 535712
  misc_feature: HIJSMM301CB85C.27.78.H01.1.454.light.4.raw

SEQ ID NO: 585133 - DNA, 444 bp, Homo sapiens; identical to SEQ ID NO: 537971
  misc_feature: HIJSMM301A7RRA.2.76.G10.1.454.light.4.raw

SEQ ID NO: 585134 - DNA, 484 bp, Homo sapiens; identical to SEQ ID NO: 540581
  misc_feature: HIJSMM301AJ4OB.3.88.H11.1.454.light.4.raw

SEQ ID NO: 585135 - DNA, 486 bp, Homo sapiens
  misc_feature: HIJSMM301BP4IQ.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaacgaactgtggctgcacc

SEQ ID NO: 585136 - DNA, 509 bp, Homo sapiens; identical to SEQ ID NO: 539359
  misc_feature: HIJSMM301DMVCA.47.85.H08.1.454.light.4.raw

SEQ ID NO: 585137 - DNA, 486 bp, Homo sapiens; identical to SEQ ID NO: 535458
  misc_feature: HIJSMM301D2AFM.7.75.G09.1.454.light.4.raw

SEQ ID NO: 585138 - DNA, 502 bp, Homo sapiens
  misc_feature: HIJSMM301A28FU.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggtaccaaggctgaccgtcctaggtcagcccaaggct

SEQ ID NO: 585139 - DNA, 494 bp, Homo sapiens; identical to SEQ ID NO: 535276
  misc_feature: HIJSMM301AVFQ0.16.6.A06.1.454.light.4.raw

SEQ ID NO: 585140 - DNA, 495 bp, Homo sapiens; identical to SEQ ID NO: 545773
  misc_feature: HIJSMM301A4DET.27.78.H01.1.454.light.4.raw

SEQ ID NO: 585141 - DNA, 509 bp, Homo sapiens
  misc_feature: HIJSMM301EPH90.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcctccctgaccatctctgggctccaggctgaggacgaggctgattattattgcagctcatatacaaacaccaaagctttgatattcggcggagggaccaaactgaccgtccttcgtcagcccaagctgccccctcggtcactctgttccca

SEQ ID NO: 585142 - DNA, 444 bp, Homo sapiens
  misc_feature: HIJSMM301AKENZ.2.76.G10.1.454.light.4.raw
acgctcgacacacgaccggtgctcgatttagtcactcatacagggtcctgggcccagtctgtgctgactcatccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctgttcccaccctcctctgtcgagcgt

SEQ ID NO: 585143 - DNA, 507 bp, Homo sapiens
  misc_feature: HIJSMM301CIPJA.22.28.C06.1.454.light.4.raw
acatacgcgtcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgttgactcagccaccctcagcgtctgggacccccgggcagagggtcaccatctcttgttctggaagcgactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggct

SEQ ID NO: 585144 - DNA, 522 bp, Homo sapiens; identical to SEQ ID NO: 581641
  misc_feature: HIJSMM301EQA6U.27.23.C01.1.454.light.4.raw

SEQ ID NO: 585145 - DNA, 488 bp, Homo sapiens; identical to SEQ ID NO: 535990
  misc_feature: HIJSMM301A4NAD.11.28.C06.1.454.light.4.raw

SEQ ID NO: 585146 - DNA, 504 bp, Homo sapiens
  misc_feature: HIJSMM301DEBMR.5.86.H09.1.454.light.4.raw
atcagacacgcacgaccggtgctcgatttagtgctatagacttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtccta

SEQ ID NO: 585147 - DNA, 500 bp, Homo sapiens
  misc_feature: HIJSMM301EXJSJ.8.42.D09.1.454.light.4.raw
ctcgcgtgtccacgaccggtgctcgatttagacacatacgcagggaaagggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtctaggtcagccaaggctgccccctcggtcactctgt

SEQ ID NO: 585148 - DNA, 313 bp, Homo sapiens
  misc_feature: HIJSMM301CKSKF.48.56.F01.1.454.light.4.raw
agtatacatacacgaccggtgctcgatttagcagacgtctgaacacacaaagggaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgtacgttcggccaagggaccaaggtggaaatcaaacgaactgtggctgcaccatctgtcttcatcttcccgccatctgatatgtatact

SEQ ID NO: 585149 - DNA, 505 bp, Homo sapiens; identical to SEQ ID NO: 552248
  misc_feature: HIJSMM301EVJ5X.11.67.G01.1.454.light.4.raw

SEQ ID NO: 585150 - DNA, 505 bp, Homo sapiens
  misc_feature: HIJSMM301BYHBL.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcttcggccaagggaccaaggtaggaaatacaaacgaactagtggctgcaccatctgtcttcatcttccccg

SEQ ID NO: 585151 - DNA, 487 bp, Homo sapiens; identical to SEQ ID NO: 536025
  misc_feature: HIJSMM301CQKXJ.17.34.D01.1.454.light.4.raw

SEQ ID NO: 585152 - DNA, 509 bp, Homo sapiens
  misc_feature: HIJSMM301BG670.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccgaacggtggaggatcaaacgaactgtggctgcaccatctgtcttcat

SEQ ID NO: 585153 - DNA, 497 bp, Homo sapiens
  misc_feature: HIJSMM301DUXEO.52.28.C06.1.454.light.4.raw
cgcagtacgacacgaccggtgctcgatttagagctcacgtattgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtcctaggtcagcccaaggctgccccctcggtca

SEQ ID NO: 585154 - DNA, 497 bp, Homo sapiens
  misc_feature: HIJSMM301AF49L.51.59.F04.1.454.light.4.raw
cgatcgtatacacgaccggtgctcgatttagtacacacacttagggattgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccccactgtcact

SEQ ID NO: 585155 - DNA, 500 bp, Homo sapiens; identical to SEQ ID NO: 546613
  misc_feature: HIJSMM301CXAUU.11.21.B10.1.454.light.4.raw

SEQ ID NO: 585156 - DNA, 499 bp, Homo sapiens
  misc_feature: HIJSMM301BXQS4.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctcgaccatctctgggctccaggctgaagacgaggctgattattactgcagctcatatacaggcagcagcactcaggttttcggtcggagggaccaagctgaccgtcctaggtcagcccaaggctcgccccctcggt

SEQ ID NO: 585157 - DNA, 497 bp, Homo sapiens; identical to SEQ ID NO: 538296
  misc_feature: HIJSMM301AKDV3.18.11.A11.1.454.light.4.raw

SEQ ID NO: 585158 - DNA, 400 bp, Homo sapiens
  misc_feature: HIJSMM301B35W1.19.10.A10.1.454.light.4.raw
tactctcgtgcacgaccggtgctcgatttagcgtcgatctcaggggggagaagagctgctcagttaggacccagagggaaccatggaaaccccagcgcagcttctcttcctcctgctactctggctcccagatagcaccggagaaattttcttgacgcagtctccaggcaccctgtctttgaccactggcatccccgacaggttcagtggcagtgtgtctgggacagacttcactctcaccatcagcagactggagcctgaagattttgcagtgtattactgtcaacgatatgatgagtcacctccgtggtggacatttggccaggggaccaaggttgaagtcaaacgaactgtggctgcaccatctgtcttcatcttcccgccatctgacacgagagta

SEQ ID NO: 585159 - DNA, 504 bp, Homo sapiens; identical to SEQ ID NO: 560731
  misc_feature: HIJSMM301EH89F.5.24.C02.1.454.light.4.raw

SEQ ID NO: 585160 - DNA, 497 bp, Homo sapiens; identical to SEQ ID NO: 537943
  misc_feature: HIJSMM301CLFKW.21.15.B04.1.454.light.4.raw

SEQ ID NO: 585161 - DNA, 518 bp, Homo sapiens
  misc_feature: HIJSMM301APS97.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtagcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacg

SEQ ID NO: 585162 - DNA, 496 bp, Homo sapiens; identical to SEQ ID NO: 535423
  misc_feature: HIJSMM301EVMO6.3.33.C11.1.454.light.4.raw

SEQ ID NO: 585163 - DNA, 497 bp, Homo sapiens
  misc_feature: HIJSMM301A1GDF.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaaggctgaccgtcctaggtcagcccaaggctgccccctcggtcactctgttcccaccctcct

SEQ ID NO: 585164 - DNA, 501 bp, Homo sapiens
  misc_feature: HIJSMM301BUMVQ.13.39.D06.1.454.light.4.raw
tcacgtactacacgaccggtgctcgatttagtgacatctcgcagttctttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaacatcggaagtaattatgtatattggtatcagcagctcccaggaacggcccccaaacagctcatctataggaataatcagcggccctcaggggtccctgaccgattctctggctccaagtctggcacctcagcctccctggccatcagtgggctccggtccgaggatgaggctgattattactgtgcagcatactatgacaccctgaatggtctttgggtgttcggcggagggaccaagctgaccgtcctaggtcagccccg

SEQ ID NO: 585165 - DNA, 422 bp, Homo sapiens
  misc_feature: HIJSMM301D028D.41.12.B01.1.454.light.4.raw
tctatactatcacgaccggtgctcgatttagtagtgtagattccgcgggcacgaccggtgctcgatttagtagcatactgttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 585166 - DNA, 516 bp, Homo sapiens
  misc_feature: HIJSMM301BANFQ.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctcgt

SEQ ID NO: 585167 - DNA, 498 bp, Homo sapiens
  misc_feature: HIJSMM301B2TYO.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggaggaccaaggtggagatcaaacgaactgtggctgcaccatctgtcttcatcttcccgccatctgacta

SEQ ID NO: 585168 - DNA, 505 bp, Homo sapiens; identical to SEQ ID NO: 535503
  misc_feature: HIJSMM301EKE1O.8.28.C06.1.454.light.4.raw

SEQ ID NO: 585169 - DNA, 498 bp, Homo sapiens
  misc_feature: HIJSMM301A5487.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggcctg

SEQ ID NO: 585170 - DNA, 495 bp, Homo sapiens
  misc_feature: HIJSMM301ETKAQ.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcggggggaccaaggtggaggatcaaacgaactgtggctgcaccatctgtt

SEQ ID NO: 585171 - DNA, 486 bp, Homo sapiens; identical to SEQ ID NO: 535523
  misc_feature: HIJSMM301A7B2D.22.73.G07.1.454.light.4.raw

SEQ ID NO: 585172 - DNA, 441 bp, Homo sapiens; identical to SEQ ID NO: 535074
  misc_feature: HIJSMM301B6WZT.11.3.A03.1.454.light.4.raw

SEQ ID NO: 585173 - DNA, 488 bp, Homo sapiens; identical to SEQ ID NO: 537504
  misc_feature: HIJSMM301D6MFY.17.57.F02.1.454.light.4.raw

SEQ ID NO: 585174 - DNA, 485 bp, Homo sapiens
  misc_feature: HIJSMM301BASHZ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgcatgcaagctctacaagtcccgctcactttcggcggaggaccaaggtggagatcaaacgaacg

SEQ ID NO: 585175 - DNA, 502 bp, Homo sapiens; identical to SEQ ID NO: 541971
  misc_feature: HIJSMM301BEFNN.4.39.D06.1.454.light.4.raw

SEQ ID NO: 585176 - DNA, 510 bp, Homo sapiens
  misc_feature: HIJSMM301CMR5X.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaacggtaggaaatacaaaacgaactagtggctcgcaccatctgtcttcatcttccccg

SEQ ID NO: 585177 - DNA, 480 bp, Homo sapiens; identical to SEQ ID NO: 535291
  misc_feature: HIJSMM301A9IXM.22.59.F04.1.454.light.4.raw

SEQ ID NO: 585178 - DNA, 498 bp, Homo sapiens; identical to SEQ ID NO: 571676
  misc_feature: HIJSMM301BLNUA.10.64.F09.1.454.light.4.raw

SEQ ID NO: 585179 - DNA, 491 bp, Homo sapiens
  misc_feature: HIJSMM301BNUIS.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaaccaggacagcctcctaagctgctcatttactgggcatctacccgggaatccggggtccctgaccgattcagtggcagcgggtctggcacagatttcactctcaccatcagcagcctgcaggctgaagatgtggcagtttattactgtcagcaatatgaaagtattccttttacttcggccctgggaccaaagtggatatcaaacgaactgtggctgcaccat

SEQ ID NO: 585180 - DNA, 487 bp, Homo sapiens
  misc_feature: HIJSMM301A2BSH.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaaacaatattattatacttcgtggacgttcggccaagggaccaaggtggatatcagacgaa

SEQ ID NO: 585181 - DNA, 500 bp, Homo sapiens
  misc_feature: HIJSMM301AUY23.40.42.D09.1.454.light.4.raw
  modified_base (239)..(239): a, c, t, g, unknown or other
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatntgcttattggtaccaacagaagtcaggccaggcccctgtgctggtcatctatgaggacaacaaacgaccctccgagatccctgagagattctctggctccagctcagggacaatggccaccttggctctcagtggggcccaggtggaggatgaagctgactactactgttactcagtggacagcagtggaaatcatggggtattcggcggagggaccaagctgaccgtcctaggtcagcccaaggctgccccctcggtcac

SEQ ID NO: 585182 - DNA, 516 bp, Homo sapiens
  misc_feature: HIJSMM301A99FS.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccgtggacgttcgccaaggacaaggtaggcatcaaccgaactgtggctgcaccatctgtcttcatcttcccg

SEQ ID NO: 585183 - DNA, 486 bp, Homo sapiens
  misc_feature: HIJSMM301BVQXZ.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacagatttcactctcaccatcagcagcctgcagactgaagatgtggcagtgtattactgtcagcaatatcacactgctccgctcactttcggcggagggaccagggtggagatcaaaacgg

SEQ ID NO: 585184 - DNA, 463 bp, Homo sapiens; identical to SEQ ID NO: 535062
  misc_feature: HIJSMM301DDFUU.11.73.G07.1.454.light.4.raw

SEQ ID NO: 585185 - DNA, 495 bp, Homo sapiens
  misc_feature: HIJSMM301BVMO5.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatatttcgtgctccgtacacttttggtccaggggacccaggtggagatcagacgaactgtggctgcaccatctgtcttcatcttcccg

SEQ ID NO: 585186 - DNA, 482 bp, Homo sapiens; identical to SEQ ID NO: 538815
  misc_feature: HIJSMM301DSLRE.4.34.D01.1.454.light.4.raw

SEQ ID NO: 585187 - DNA, 449 bp, Homo sapiens
  misc_feature: HIJSMM301C7LQE.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtctaggtcagcccaaggccaaccccactgtcactctgttcccaccctcctccatact

SEQ ID NO: 585188 - DNA, 515 bp, Homo sapiens
  misc_feature: HIJSMM301CY1Q4.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtacttcacccccggacgttcggccgaaggaccgaacggtaggaagtacaaacgaactagtggcgtgcaccatactcgtcttctatcttcccgtccact

SEQ ID NO: 585189 - DNA, 497 bp, Homo sapiens; identical to SEQ ID NO: 536371
  misc_feature: HIJSMM301CHL1A.16.78.H01.1.454.light.4.raw

SEQ ID NO: 585190 - DNA, 488 bp, Homo sapiens; identical to SEQ ID NO: 537124
  misc_feature: HIJSMM301APVFP.11.25.C03.1.454.light.4.raw

SEQ ID NO: 585191 - DNA, 443 bp, Homo sapiens; identical to SEQ ID NO: 563129
  misc_feature: HIJSMM301AF0CW.11.3.A03.1.454.light.4.raw

SEQ ID NO: 585192 - DNA, 504 bp, Homo sapiens
  misc_feature: HIJSMM301BBRKN.47.55.E11.1.454.light.4.raw
agctcacgtacacgaccggtgctcgatttagcactcgcacgtagggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggcccaaccccactgtcactctgttcccaccctcctcta

SEQ ID NO: 585193 - DNA, 509 bp, Homo sapiens
  misc_feature: HIJSMM301CX1J5.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggccctgggaccaaggtggaggatcaaacgaactgtggctgcaccatctgtcttcta

SEQ ID NO: 585194 - DNA, 483 bp, Homo sapiens
  misc_feature: HIJSMM301A9YV7.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttcccgcatctgactagtctacg

SEQ ID NO: 585195 - DNA, 361 bp, Homo sapiens; identical to SEQ ID NO: 544890
  misc_feature: HIJSMM301CTG9V.3.57.F02.1.454.light.4.raw

SEQ ID NO: 585196 - DNA, 504 bp, Homo sapiens
  misc_feature: HIJSMM301EJQ7P.48.27.C05.1.454.light.4.raw
agtatacatacacgaccggtgctcgatttagacgcgatcgaagggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatgtggtattcggcggagggaccaagctgaccgtcctaggtcagcccaaggctcgccccccg

SEQ ID NO: 585197 - DNA, 503 bp, Homo sapiens; identical to SEQ ID NO: 580633
  misc_feature: HIJSMM301CHEZ0.21.38.D05.1.454.light.4.raw

SEQ ID NO: 585198 - DNA, 486 bp, Homo sapiens
  misc_feature: HIJSMM301DFNSS.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtcactctgttcccgccctcctctacgtgagct

SEQ ID NO: 585199 - DNA, 488 bp, Homo sapiens
  misc_feature: HIJSMM301CK9K6.14.33.C11.1.454.light.4.raw
cgtctagtaccacgaccggtgctcgatttagagtgagctcgttgggtttgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgcccctcggtcactctgttcccaccctcctcgtactagacg

SEQ ID NO: 585200 - DNA, 490 bp, Homo sapiens; identical to SEQ ID NO: 535234
  misc_feature: HIJSMM301AFHC1.17.21.B10.1.454.light.4.raw

SEQ ID NO: 585201 - DNA, 502 bp, Homo sapiens; identical to SEQ ID NO: 537816
  misc_feature: HIJSMM301BZRUN.19.78.H01.1.454.light.4.raw

SEQ ID NO: 585202 - DNA, 503 bp, Homo sapiens
  misc_feature: HIJSMM301DT5KL.27.78.H01.1.454.light.4.raw
  modified_base (412)..(412): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaanctgaagatgctgcaacttattactgtcatcagagtactactttacctcaagtgatcaccttcggccaagggacacgactggagattaaacg

SEQ ID NO: 585203 - DNA, 481 bp, Homo sapiens; identical to SEQ ID NO: 535993
  misc_feature: HIJSMM301CQFAD.21.25.C03.1.454.light.4.raw

SEQ ID NO: 585204 - DNA, 508 bp, Homo sapiens
  misc_feature: HIJSMM301CNKWV.9.55.E11.1.454.light.4.raw
tgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctgggaaaacggccaccctgaccatcagcagggtcgaagccggggatgaggccgactattactgtcaggtgtgggctggtgataatgatcatgcgggggtgttcgggcggagggaccaagctgaccgtcctaagtcagcccaaggctgccccctggtcactctcg

SEQ ID NO: 585205 - DNA, 493 bp, Homo sapiens; identical to SEQ ID NO: 537239
  misc_feature: HIJSMM301DG1FW.49.66.F11.1.454.light.4.raw

SEQ ID NO: 585206 - DNA, 485 bp, Homo sapiens
  misc_feature: HIJSMM301AGGW5.5.34.D01.1.454.light.4.raw
atcagacacgcacgaccggtgctcgatttagatcgtctgtgttgggtttgggggcaggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctccgaccttcgccaaggacgacgacctggagattaaacgtaaactacgtggct

SEQ ID NO: 585207 - DNA, 494 bp, Homo sapiens; identical to SEQ ID NO: 534994
  misc_feature: HIJSMM301DYD4Z.27.78.H01.1.454.light.4.raw

SEQ ID NO: 585208 - DNA, 521 bp, Homo sapiens; identical to SEQ ID NO: 538715
  misc_feature: HIJSMM301A8OXM.27.23.C01.1.454.light.4.raw

SEQ ID NO: 585209 - DNA, 474 bp, Homo sapiens; identical to SEQ ID NO: 561309
  misc_feature: HIJSMM301BYO5R.5.12.B01.1.454.light.4.raw

SEQ ID NO: 585210 - DNA, 498 bp, Homo sapiens; identical to SEQ ID NO: 536879
  misc_feature: HIJSMM301EP9M3.22.14.B03.1.454.light.4.raw

SEQ ID NO: 585211 - DNA, 507 bp, Homo sapiens
  misc_feature: HIJSMM301AXI12.18.78.H01.1.454.light.4.raw
tacgagtatgcacgaccggtgctcgatttagtgtgagtagtttggggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggactgggaccaaggtcaccgtcctaggtcagcccaaggccaacccccactgtca

SEQ ID NO: 585212 - DNA, 508 bp, Homo sapiens
  misc_feature: HIJSMM301CF5J5.15.1.A01.1.454.light.4.raw
tctacgtagccacgaccggtgctcgatttagacgtctcatcaggggggggtcgtacgaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggcctgcccccctgggtccactt

SEQ ID NO: 585213 - DNA, 493 bp, Homo sapiens; identical to SEQ ID NO: 539702
  misc_feature: HIJSMM301C7D3G.27.78.H01.1.454.light.4.raw

SEQ ID NO: 585214 - DNA, 488 bp, Homo sapiens; identical to SEQ ID NO: 539612
  misc_feature: HIJSMM301EQRVS.3.55.E11.1.454.light.4.raw

SEQ ID NO: 585215 - DNA, 482 bp, Homo sapiens
  misc_feature: HIJSMM301CK8SX.51.76.G10.1.454.light.4.raw
cgatcgtatacacgaccggtgctcgatttagtcactcatacaggggagagctctggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagtagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgt

SEQ ID NO: 585216 - DNA, 487 bp, Homo sapiens
  misc_feature: HIJSMM301CTI31.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtcaagcgaactgtgctgcaccatctgt

SEQ ID NO: 585217 - DNA, 500 bp, Homo sapiens
  misc_feature: HIJSMM301CR21Q.9.12.B01.1.454.light.4.raw
tgatacgtctcacgaccggtgctcgatttagtagtgtagattccgcgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactgtggctgcaccatctgtcttcta

SEQ ID NO: 585218 - DNA, 514 bp, Homo sapiens
  misc_feature: HIJSMM301BZ4DO.11.57.F02.1.454.light.4.raw
cgagagataccacgaccggtgctcgatttagctcgatatagttggggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcttgcagggccagtcaaaatattaacaactacttagcctggttccaacagaaacctggccaggctcccaggctcctcatctatgatgcatttaggagggccactggcatcccacccaggttcagtggcagtgggtctggggacagacttcattctcaccatccgcagcctagagcctgaagattttgcagtttattactgtcaacagcgtagcagcaggcctccggcgacgttcggccaagggacaacggtggaagtcaagcgaactgtggctggcaccatctgtcttcatcttcccgccactc

SEQ ID NO: 585219 - DNA, 490 bp, Homo sapiens
  misc_feature: HIJSMM301AER7M.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaaactgt

SEQ ID NO: 585220 - DNA, 519 bp, Homo sapiens
  misc_feature: HIJSMM301C35N7.40.27.C05.1.454.light.4.raw
  modified_base (201)..(201): a, c, t, g, unknown or other
tctagcgactcacgaccggtgctcgatttagacgcgatcgaagggtttggggagcttcagctgtggtggagaagacaggattcaggccaatctccagcatggccggcttccctctcctcctcaccctcctcactcactgtgcagggtcctgggcccagtctgtgctgactcagccaccctcagcgtctgagacccccgggnagcaggttaccgtctcttgttctggaagcagctccaacatcggaagtaattctgtatactggtaccagtgcctcccaggaacggcccccaaacttctcgtctatagggattatcagcggcccttaggggtccctgaccgattctctggctccaggtctggcacctcagcctccctggccatcagtgggctccggcccgaggatgaggcggattattattgtgtgtcatgggatgacagaatgaatggtccggtgttcggcggagggaccaggctgaccgtcctaggtcagcccaaggctgccccctcggtcactctcg

SEQ ID NO: 585221 - DNA, 490 bp, Homo sapiens; identical to SEQ ID NO: 535526
  misc_feature: HIJSMM301A5E7I.26.78.H01.1.454.light.4.raw

SEQ ID NO: 585222 - DNA, 490 bp, Homo sapiens
  misc_feature: HIJSMM301DPCJW.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaaggaccgacgggtggaaagtacaaacgaactagtggctgtcaccatctgtctt

SEQ ID NO: 585223 - DNA, 498 bp, Homo sapiens
  misc_feature: HIJSMM301EL3N2.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcgcgggggaccaagctggagatcaaccgaactgtggctgcaccatctgtcttcatcttcccg

SEQ ID NO: 585224 - DNA, 495 bp, Homo sapiens
  misc_feature: HIJSMM301AS09Y.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggtaccgaaagtaggagtaattcaaacgaaactagtggctgcaccaatctgtt

SEQ ID NO: 585225 - DNA, 505 bp, Homo sapiens; identical to SEQ ID NO: 555429
  misc_feature: HIJSMM301DNOIK.4.71.G05.1.454.light.4.raw

SEQ ID NO: 585226 - DNA, 474 bp, Homo sapiens
  misc_feature: HIJSMM301BC8F0.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgcctacttttggcggggggtaccaaggtggacatcaaacgaa

SEQ ID NO: 585227 - DNA, 487 bp, Homo sapiens; identical to SEQ ID NO: 536206
  misc_feature: HIJSMM301EH699.47.38.D05.1.454.light.4.raw

SEQ ID NO: 585228 - DNA, 494 bp, Homo sapiens; identical to SEQ ID NO: 534994
  misc_feature: HIJSMM301CGGGQ.27.78.H01.1.454.light.4.raw

SEQ ID NO: 585229 - DNA, 507 bp, Homo sapiens; identical to SEQ ID NO: 556531
  misc_feature: HIJSMM301BY185.15.5.A05.1.454.light.4.raw

SEQ ID NO: 585230 - DNA, 474 bp, Homo sapiens; identical to SEQ ID NO: 580149
  misc_feature: HIJSMM301BAQPS.7.81.H04.1.454.light.4.raw

SEQ ID NO: 585231 - DNA, 494 bp, Homo sapiens; identical to SEQ ID NO: 534994
  misc_feature: HIJSMM301CASH4.27.78.H01.1.454.light.4.raw

SEQ ID NO: 585232 - DNA, 445 bp, Homo sapiens
  misc_feature: HIJSMM301EYKKQ.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaacccctcatctatggtaatagtaatcggccctcaggggtcccgtgaccgattctctggctccaagtctggcacctcagcctccctggccatcactgggcttcaggctgaggatgaggctgattattactgccactcctatgacagcagcctgagaagtgtggtattcggcggagggaccaagctgaccgtcctaggtcagcccaaggctgccccctcggtcactctgttcccaccctcctcagacgtatca

SEQ ID NO: 585233 - DNA, 486 bp, Homo sapiens; identical to SEQ ID NO: 537238
  misc_feature: HIJSMM301DKT6H.19.71.G05.1.454.light.4.raw

SEQ ID NO: 585234 - DNA, 509 bp, Homo sapiens
  misc_feature: HIJSMM301DOU2Q.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaggacggttgggtgttcggcggagggaccaagctgaccgtccaggtcagcccaaggctgccccctggtcactctgttcccaccctcctcgctacgt

SEQ ID NO: 585235 - DNA, 484 bp, Homo sapiens; identical to SEQ ID NO: 535240
  misc_feature: HIJSMM301BF3DT.47.60.F05.1.454.light.4.raw

SEQ ID NO: 585236 - DNA, 495 bp, Homo sapiens; identical to SEQ ID NO: 541961
  misc_feature: HIJSMM301EJCIY.21.27.C05.1.454.light.4.raw
  modified_base (198)..(198): a, c, t, g, unknown or other

SEQ ID NO: 585237 - DNA, 512 bp, Homo sapiens
  misc_feature: HIJSMM301C9T6P.49.37.D04.1.454.light.4.raw
agtcgagagacacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcggcggagggaccaagctgaccgtcctaggtcagcccaaggctgccccctcggtcactctgttcccaccct

SEQ ID NO: 585238 - DNA, 445 bp, Homo sapiens
  misc_feature: HIJSMM301DL80G.2.76.G10.1.454.light.4.raw
acgctcgacacacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggagggaccaagttgaccgtcctaagtcagcccaaggctgccccctcggtcactctcgttcccaccctcctctgtcgagcgt

SEQ ID NO: 585239 - DNA, 503 bp, Homo sapiens
  misc_feature: HIJSMM301CRSYO.53.35.D02.1.454.light.4.raw
cgcgtatacacacgaccggtgctcgatttagcacacgatagttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggcctgccccctcggtcactctgtt

SEQ ID NO: 585240 - DNA, 488 bp, Homo sapiens; identical to SEQ ID NO: 536554
  misc_feature: HIJSMM301DL9F8.26.37.D04.1.454.light.4.raw

SEQ ID NO: 585241 - DNA, 491 bp, Homo sapiens
  misc_feature: HIJSMM301B4IGX.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaagttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttcatt

SEQ ID NO: 585242 - DNA, 486 bp, Homo sapiens
  misc_feature: HIJSMM301CHFYU.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtggggctgaggatgttggcatttatactgcatgcaggctatacaccttcctgccacttttggtcaggggaccaagctggagatcaggcgaacg

SEQ ID NO: 585243 - DNA, 501 bp, Homo sapiens
  misc_feature: HIJSMM301ATFJP.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctagtcagcccaaggccaaccccactgtca

SEQ ID NO: 585244 - DNA, 501 bp, Homo sapiens; identical to SEQ ID NO: 579640
  misc_feature: HIJSMM301C8V6K.9.81.H04.1.454.light.4.raw

SEQ ID NO: 585245 - DNA, 460 bp, Homo sapiens; identical to SEQ ID NO: 537107
  misc_feature: HIJSMM301EK6NH.22.28.C06.1.454.light.4.raw

SEQ ID NO: 585246 - DNA, 495 bp, Homo sapiens
  misc_feature: HIJSMM301D4IO7.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtaggctgcaccatctgtcttcatcttccccg

SEQ ID NO: 585247 - DNA, 489 bp, Homo sapiens; identical to SEQ ID NO: 535139
  misc_feature: HIJSMM301EXDW1.14.55.E11.1.454.light.4.raw

SEQ ID NO: 585248 - DNA, 494 bp, Homo sapiens; identical to SEQ ID NO: 534992
  misc_feature: HIJSMM301EPTJ0.9.1.A01.1.454.light.4.raw

SEQ ID NO: 585249 - DNA, 433 bp, Homo sapiens; identical to SEQ ID NO: 535093
  misc_feature: HIJSMM301BT48H.18.5.A05.1.454.light.4.raw

SEQ ID NO: 585250 - DNA, 483 bp, Homo sapiens
  misc_feature: HIJSMM301B5DFO.46.26.C04.1.454.light.4.raw
  modified_base (433)..(433): a, c, t, g, unknown or other
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctntacaagtcccgctcactttcggcggaggaccaaggtggagatcaaacgaa

SEQ ID NO: 585251 - DNA, 487 bp, Homo sapiens
  misc_feature: HIJSMM301ARRON.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggtcggagggaccacggtggagatcaaacgaaactgtggctgcaccatctgtcttcta

SEQ ID NO: 585252 - DNA, 472 bp, Homo sapiens
  misc_feature: HIJSMM301AUBC6.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggcggggggtaccaaggtggacatcaacgaa

SEQ ID NO: 585253 - DNA, 500 bp, Homo sapiens
  misc_feature: HIJSMM301CYVIF.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcgagggaccaagctgacgtcctgcgtcagcccaaggctgccccctcggtcactc

SEQ ID NO: 585254 - DNA, 499 bp, Homo sapiens
  misc_feature: HIJSMM301ERXYL.48.82.H05.1.454.light.4.raw
agtatacatacacgaccggtgctcgatttagtcgagctctctcgcggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgagggacgaggctgattattactgcacctcatatacaagcagcagcactctcgtggtattcggcggagggaccaagctgaccgtcctaggtcagcccaaggctgccccctc

SEQ ID NO: 585255 - DNA, 496 bp, Homo sapiens
  misc_feature: HIJSMM301C3L2C.10.33.C11.1.454.light.4.raw
catagtagtgcacgaccggtgctcgatttagagtgagctcgttgggtttgggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcgggggaccaaggtggagttcaaacgaactgtggctgcaccatctgtcttcattcc

SEQ ID NO: 585256 - DNA, 496 bp, Homo sapiens
  misc_feature: HIJSMM301A5Y4M.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccgaacggttagtagatcaaacgaaactagtggcgtcgcacca

SEQ ID NO: 585257 - DNA, 517 bp, Homo sapiens; identical to SEQ ID NO: 557301
  misc_feature: HIJSMM301EU4UW.19.80.H03.1.454.light.4.raw

SEQ ID NO: 585258 - DNA, 504 bp, Homo sapiens; identical to SEQ ID NO: 544677
  misc_feature: HIJSMM301C7XJ0.7.71.G05.1.454.light.4.raw

SEQ ID NO: 585259 - DNA, 499 bp, Homo sapiens
  misc_feature: HIJSMM301EBYAE.48.35.D02.1.454.light.4.raw
agtatacatacacgaccggtgctcgatttagcacacgatagttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccc

SEQ ID NO: 585260 - DNA, 489 bp, Homo sapiens; identical to SEQ ID NO: 540381
  misc_feature: HIJSMM301AEWOC.51.6.A06.1.454.light.4.raw

SEQ ID NO: 585261 - DNA, 482 bp, Homo sapiens; identical to SEQ ID NO: 535352
  misc_feature: HIJSMM301BXLDZ.16.81.H04.1.454.light.4.raw

SEQ ID NO: 585262 - DNA, 488 bp, Homo sapiens; identical to SEQ ID NO: 540827
  misc_feature: HIJSMM301B7624.15.49.E05.1.454.light.4.raw

SEQ ID NO: 585263 - DNA, 447 bp, Homo sapiens; identical to SEQ ID NO: 535201
  misc_feature: HIJSMM301ADF88.18.9.A09.1.454.light.4.raw

SEQ ID NO: 585264 - DNA, 522 bp, Homo sapiens
  misc_feature: HIJSMM301CKW0J.27.23.C01.1.454.light.4.raw
agcgtcgtctcacgaccggtgctcgatttagtacacgtgattagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccaccct

SEQ ID NO: 585265 - DNA, 498 bp, Homo sapiens
  misc_feature: HIJSMM301EXDGS.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgctagtttattactgtcagcagtataataactggcctcgggacgttcggccaagggaccaacggtggaagtcaaacgaactgtggctgcaccatctgtcttctatcttcccgt

SEQ ID NO: 585266 - DNA, 509 bp, Homo sapiens; identical to SEQ ID NO: 535670
  misc_feature: HIJSMM301DTEZS.47.23.C01.1.454.light.4.raw

SEQ ID NO: 585267 - DNA, 493 bp, Homo sapiens
  misc_feature: HIJSMM301BJTT2.49.61.F06.1.454.light.4.raw
agtcgagagacacgaccggtgctcgatttagctacgctctaagggaaagggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcaacagcctagagcctgaagattctgcagtttattactgtcagcagcgtagcaactggcctctcactttcggcggagggaccaaggtggagatcaaacgaactgtggctgcaccatctgtcttc

SEQ ID NO: 585268 - DNA, 489 bp, Homo sapiens; identical to SEQ ID NO: 535139
  misc_feature: HIJSMM301DL3RN.14.55.E11.1.454.light.4.raw

SEQ ID NO: 585269 - DNA, 495 bp, Homo sapiens; identical to SEQ ID NO: 538651
  misc_feature: HIJSMM301AQ98V.10.79.H02.1.454.light.4.raw

SEQ ID NO: 585270 - DNA, 484 bp, Homo sapiens; identical to SEQ ID NO: 535400
  misc_feature: HIJSMM301AUVGQ.46.26.C04.1.454.light.4.raw

SEQ ID NO: 585271 - DNA, 495 bp, Homo sapiens
  misc_feature: HIJSMM301DWN39.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtcgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaccttcggccaggggacacgactggagattaagcgaactgtggctgcaccatctgtctt

SEQ ID NO: 585272 - DNA, 494 bp, Homo sapiens; identical to SEQ ID NO: 537003
  misc_feature: HIJSMM301CC66F.10.79.H02.1.454.light.4.raw

SEQ ID NO: 585273 - DNA, 482 bp, Homo sapiens
  misc_feature: HIJSMM301AOZK1.13.50.E06.1.454.light.4.raw
tcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctgaccaggctcccaggctcctcatttatggtgcatccactagggccactggtgtcccagtcaggttcagcggcagtgggtctgggacagacttcactctcaccatcagcagcctgcagtctgaagattttgcagtctattactgtcagcagtatagttactggagaaccttcggccaagggacacgactggagattaaaggaactgtggctgcacc

SEQ ID NO: 585274 - DNA, 502 bp, Homo sapiens; identical to SEQ ID NO: 543936
  misc_feature: HIJSMM301DYF7R.15.1.A01.1.454.light.4.raw

SEQ ID NO: 585275 - DNA, 506 bp, Homo sapiens
  misc_feature: HIJSMM301DIY2H.43.33.C11.1.454.light.4.raw
tgtgagtagtcacgaccggtgctcgatttagagtgagctcgttgggtttggggagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctcccccctacctaattcggttcacggggaccgaacgttaggaacaatcaatacgaacctagttggcgtgcaaccactctgtt

SEQ ID NO: 585276 - DNA, 447 bp, Homo sapiens; identical to SEQ ID NO: 535201
  misc_feature: HIJSMM301DXLGZ.18.9.A09.1.454.light.4.raw

SEQ ID NO: 585277 - DNA, 502 bp, Homo sapiens; identical to SEQ ID NO: 541615
  misc_feature: HIJSMM301DXVL8.21.26.C04.1.454.light.4.raw

SEQ ID NO: 585278 - DNA, 490 bp, Homo sapiens
  misc_feature: HIJSMM301BA5ES.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatcatttaatttcggcggagggaccaaggtggagatcaaacgaactgtgctgcaccatctgtcttcatcttcccgccta

SEQ ID NO: 585279 - DNA, 471 bp, Homo sapiens
  misc_feature: HIJSMM301BBY57.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctggactgaagtgcatatgaagagaactgtggct

SEQ ID NO: 585280 - DNA, 493 bp, Homo sapiens
  misc_feature: HIJSMM301BL9W3.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagatttgcagtgtattactgtcagcagtatggtagctcacctcggacgttcggccaaggaccgaaggtaggaaatacaaacgaactagtggctgcaccatctgtt

SEQ ID NO: 585281 - DNA, 500 bp, Homo sapiens; identical to SEQ ID NO: 542309
  misc_feature: HIJSMM301C0Y67.12.86.H09.1.454.light.4.raw

SEQ ID NO: 585282 - DNA, 500 bp, Homo sapiens
  misc_feature: HIJSMM301EWE97.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctgccccctcggtcactctgttcccaccctcccaccg

SEQ ID NO: 585283 - DNA, 488 bp, Homo sapiens
  misc_feature: HIJSMM301ASN15.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgccccctcggtcactctcgttcccgccctccctcgctacgtaga

SEQ ID NO: 585284 - DNA, 516 bp, Homo sapiens
  misc_feature: HIJSMM301CHT5M.48.14.B03.1.454.light.4.raw
agtatacatacacgaccggtgctcgatttagtgtgagtagttccgcggggactgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaacgggacccgggtcggaaataaaacgaaactagtggctgcaccatctgtcttcta

SEQ ID NO: 585285 - DNA, 490 bp, Homo sapiens; identical to SEQ ID NO: 581831
  misc_feature: HIJSMM301DQ9BT.16.68.G02.1.454.light.4.raw

SEQ ID NO: 585286 - DNA, 503 bp, Homo sapiens; identical to SEQ ID NO: 538884
  misc_feature: HIJSMM301ETPVH.27.78.H01.1.454.light.4.raw

SEQ ID NO: 585287 - DNA, 502 bp, Homo sapiens; identical to SEQ ID NO: 541971
  misc_feature: HIJSMM301BB31S.4.39.D06.1.454.light.4.raw

SEQ ID NO: 585288 - DNA, 503 bp, Homo sapiens; identical to SEQ ID NO: 543299
  misc_feature: HIJSMM301DJWC7.48.36.D03.1.454.light.4.raw

SEQ ID NO: 585289 - DNA, 493 bp, Homo sapiens
  misc_feature: HIJSMM301EWMIX.40.33.C11.1.454.light.4.raw
tctagcgactcacgaccggtgctcgatttagagtgagctcgttgggtttggggagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtgggggtgccacttgggtgttcggcggagggaccaagctgaccgtcctaggtcagccc

SEQ ID NO: 585290 - DNA, 492 bp, Homo sapiens
  misc_feature: HIJSMM301CRQOO.9.34.D01.1.454.light.4.raw
tgatacgtctcacgaccggtgctcgatttagatcgtctgtgttgggtttgggggctctgcttcagctgtgggcacaagaggcagcactcaggacaatctccagcatggcctggtctcctctcctcctcactctcctcgctcactgcacagggtcctgggcccagtctgttctgacgcagccgccctcagtgtctggggccccagggcagagggtcaccatctcgtgcactggaagtagctccaacatcggggcacgttatgatgtacactggtaccaacaacttccaggaacagcccccaaagtcatcatttatgacaacatgaagcggccctcaggggtccctgaccgattctccggctccaagtctggcacatcagcctccctggccatcactgggctccaggctgaggatgaggctgactattactgccagtcgtatgacagtgcctaagtaacatcgtcttcggaactgggaccaaggtcaccgtccg

SEQ ID NO: 585291 - DNA, 480 bp, Homo sapiens; identical to SEQ ID NO: 556526
  misc_feature: HIJSMM301CN5Z0.11.76.G10.1.454.light.4.raw

SEQ ID NO: 585292 - DNA, 501 bp, Homo sapiens; identical to SEQ ID NO: 536818
  misc_feature: HIJSMM301BTVD7.12.82.H05.1.454.light.4.raw

SEQ ID NO: 585293 - DNA, 506 bp, Homo sapiens
  misc_feature: HIJSMM301B0AMD.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcgggggaccgaggcgtgaccgtcggcggtcagcccaaggctgccccctcggtcactctgttcccaccctcct

SEQ ID NO: 585294 - DNA, 460 bp, Homo sapiens; identical to SEQ ID NO: 536053
  misc_feature: HIJSMM301C9M9E.22.28.C06.1.454.light.4.raw

SEQ ID NO: 585295 - DNA, 489 bp, Homo sapiens
  misc_feature: HIJSMM301C6847.49.30.C08.1.454.light.4.raw
agtcgagagacacgaccggtgctcgatttagtctgacgtcaaagggaaagggggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcacc

SEQ ID NO: 585296 - DNA, 473 bp, Homo sapiens; identical to SEQ ID NO: 538875
  misc_feature: HIJSMM301CL1SI.4.75.G09.1.454.light.4.raw

SEQ ID NO: 585297 - DNA, 486 bp, Homo sapiens
  misc_feature: HIJSMM301EWIEG.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacacttttggccaggggaccaaactggacatcaaacgaactgtggctgcacatctgt

SEQ ID NO: 585298 - DNA, 493 bp, Homo sapiens; identical to SEQ ID NO: 546762
  misc_feature: HIJSMM301CALJH.26.12.B01.1.454.light.4.raw

SEQ ID NO: 585299 - DNA, 504 bp, Homo sapiens; identical to SEQ ID NO: 552754
  misc_feature: HIJSMM301C2RR0.2.35.D02.1.454.light.4.raw

SEQ ID NO: 585300 - DNA, 531 bp, Homo sapiens
  misc_feature: HIJSMM301BJVHB.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgctttataacttttatctgttggtaccgacaggaccccaggcactgtccccaaactcattctttatgatgtcagtaatcggcccccaggggtttctgatcgcttctatggctccaagtctgcctacaccggacctccctgaccatctccgggctccagcctgaggacgaggctgattattattgtagttcatatacaaccagtgacacttgggtgttcgggcggagggaccaggctgaccgtcctaggtcagcccaaggctcgccccctcggtcctactctcgttcccaccct

SEQ ID NO: 585301 - DNA, 497 bp, Homo sapiens
  misc_feature: HIJSMM301ADNZ0.40.22.B11.1.454.light.4.raw
tctagcgactcacgaccggtgctcgatttagacgacagctcaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccgggtccctgacaggttcagtggcagtggatcaggtacagattttacactagaaaatcagcagagtggaggctggaggatggttggggtttatttactgcatgcaagctctacaattcctcggacgtcggtccaagggaccgaaggtaggaagtacaaacgaactagtaggcgtgc

SEQ ID NO: 585302 - DNA, 485 bp, Homo sapiens; identical to SEQ ID NO: 535985
  misc_feature: HIJSMM301AJEBS.15.1.A01.1.454.light.4.raw

SEQ ID NO: 585303 - DNA, 448 bp, Homo sapiens
  misc_feature: HIJSMM301EEW18.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctcgtcactctgttcccgccctcctccatactcgta

SEQ ID NO: 585304 - DNA, 486 bp, Homo sapiens
  misc_feature: HIJSMM301D9UWU.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacggtcccaagaacttttggccagggaccaagctggagatcaaacgaactgtggctgcaccat

SEQ ID NO: 585305 - DNA, 467 bp, Homo sapiens
  misc_feature: HIJSMM301EP3J9.40.76.G10.1.454.light.4.raw
tctagcgactcacgaccggtgctcgatttagtcactcatacagggggcagaagtctctctcagtcaggacacagcatggacatgagggtccctgctcagctcctgggactcctgctgctctggctcccagataccagatgtgacatccagatgacccagtctccatcttccctgtctgcgtctgtaggagacagagtcaccatcacttgccgggcgagtcaggacattggcatttatgtagcctggtataaggagacaccaggaaaagttcctcaactcctgatctatggtgcatccactctgcacttcggggtcccatctcggttcagcggcagcggatctgggacacatttcactctcaccatcagcagcctgcagcctgaagatgttgcagtttattactgtcaaaagtatgacactgtcccgctcactttcggcggtagggaccaaggtggagatgaagggaa

SEQ ID NO: 585306 - DNA, 503 bp, Homo sapiens; identical to SEQ ID NO: 568855
  misc_feature: HIJSMM301EPSH1.9.71.G05.1.454.light.4.raw

SEQ ID NO: 585307 - DNA, 493 bp, Homo sapiens
  misc_feature: HIJSMM301DIJFN.52.27.C05.1.454.light.4.raw
cgcagtacgacacgaccggtgctcgatttagacgcgatcgaagggtttgggggtgggggcacttctccctctaacactctccccgctcagctcctggggctcctgctactctggctccgaggtgccagatgtgacacccagatgacccagtctccatcctccctgtctgcatctgtaggagacagagtcaccatcacgtgccgggcaagtcagagcattggcaggtatttaaattggtatcaacagaaaccagggaaagcccctaggctcctgatctatgctgcatcccgtttgcaaagtggggtcccgtcaaggttcagtggccgtggatctgggacagatttcactctcaccatcagcagtctccaacctgaagattttgcaatttactactgtcaacagagtgacaatacccctcagactttcggccctgggaccagagtggatatcaaacgaactgtggctgcaccatctgtcttcatcttcccgccat

SEQ ID NO: 585308 - DNA, 484 bp, Homo sapiens; identical to SEQ ID NO: 535211
  misc_feature: HIJSMM301ALYAO.47.46.E02.1.454.light.4.raw

SEQ ID NO: 585309 - DNA, 447 bp, Homo sapiens; identical to SEQ ID NO: 535020
  misc_feature: HIJSMM301ATDB1.18.9.A09.1.454.light.4.raw

SEQ ID NO: 585310 - DNA, 472 bp, Homo sapiens
  misc_feature: HIJSMM301C4UNB.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttggccaggggaccaagctggagatcagacg

SEQ ID NO: 585311 - DNA, 492 bp, Homo sapiens
  misc_feature: HIJSMM301D38EE.10.72.G06.1.454.light.4.raw
catagtagtgcacgaccggtgctcgatttagctacgactgcaagggaaaggggggggtctcaggaggcagcgctctcgggacgtctccaccatggcctgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccaggccaggcccccagactcatcatttctgatgtcagtgatcggccctttgggatttctaatcgcttctctgcctcaagtctggcaacacggcttccctgaccatctccgggctccacgctgaggacgaggctcattattactgcagctcatatacacccaggggcactctcgtgatattcggcggagggacctggctgaccgtcctacgtcagcccaac

SEQ ID NO: 585312 - DNA, 467 bp, Homo sapiens
  misc_feature: HIJSMM301CIS0N.13.4.A04.1.454.light.4.raw
  modified_base (458)..(458): a, c, t, g, unknown or other
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacgaggggtcccatcaaggttcagtggaagtggatcgtgggacagtattttactttcaccatcagcagcctgcagcctgaagatattgcaacatattactgtcagcagtatgataatctcccgatcaccttggccaagggacacgactgganattaacgaa

SEQ ID NO: 585313 - DNA, 522 bp, Homo sapiens
  misc_feature: HIJSMM301AJT0F.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatattacaaccagtgacacttgggtgttcggcggagggaccaggctgaccgtcctaggtcagcccaaggctgccccctcggtcactctgttcccaccct

SEQ ID NO: 585314 - DNA, 468 bp, Homo sapiens
  misc_feature: HIJSMM301DK43T.51.1.A01.1.454.light.4.raw
cgatcgtatacacgaccggtgctcgatttagacgtctcatcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggtagggaccaaggtgggatcaaacgaact

SEQ ID NO: 585315 - DNA, 516 bp, Homo sapiens
  misc_feature: HIJSMM301BQCZ4.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgccccctcggtcactctcgttcccaccct

SEQ ID NO: 585316 - DNA, 504 bp, Homo sapiens
  misc_feature: HIJSMM301BADYI.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagcttccctgaccatcactggggctcaggcggaagatgaggctgactattactgtaactcccgggacagcagtgctgaccaggtggtattcggcggagggacccacctgaccgtcttaggtcagcccaaggctgccccctcggtctacc

SEQ ID NO: 585317 - DNA, 529 bp, Homo sapiens
  misc_feature: HIJSMM301ANTY2.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaacggaccgaacggtaggaagtacgaaacgaacgtacgtggcgtgcaccactactgtcttcctactcttcccgtcccactctcgata

SEQ ID NO: 585318 - DNA, 513 bp, Homo sapiens
  misc_feature: HIJSMM301CX2GM.40.18.B07.1.454.light.4.raw
tctagcgactcacgaccggtgctcgatttagtcgctgcgtaagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctgttccccg

SEQ ID NO: 585319 - DNA, 506 bp, Homo sapiens; identical to SEQ ID NO: 539721
  misc_feature: HIJSMM301CNSET.3.79.H02.1.454.light.4.raw

SEQ ID NO: 585320 - DNA, 447 bp, Homo sapiens; identical to SEQ ID NO: 535020
  misc_feature: HIJSMM301BJ8PP.18.9.A09.1.454.light.4.raw

SEQ ID NO: 585321 - DNA, 491 bp, Homo sapiens
  misc_feature: HIJSMM301AOKZC.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatacaaacgaacta

SEQ ID NO: 585322 - DNA, 495 bp, Homo sapiens; identical to SEQ ID NO: 535486
  misc_feature: HIJSMM301EYC1J.26.72.G06.1.454.light.4.raw

SEQ ID NO: 585323 - DNA, 510 bp, Homo sapiens; identical to SEQ ID NO: 546498
  misc_feature: HIJSMM301B2TX6.47.55.E11.1.454.light.4.raw

SEQ ID NO: 585324 - DNA, 485 bp, Homo sapiens; identical to SEQ ID NO: 536630
  misc_feature: HIJSMM301ESV10.13.56.F01.1.454.light.4.raw

SEQ ID NO: 585325 - DNA, 507 bp, Homo sapiens; identical to SEQ ID NO: 538063
  misc_feature: HIJSMM301EWDL4.47.85.H08.1.454.light.4.raw

SEQ ID NO: 585326 - DNA, 484 bp, Homo sapiens; identical to SEQ ID NO: 537878
  misc_feature: HIJSMM301BB0N2.17.34.D01.1.454.light.4.raw

SEQ ID NO: 585327 - DNA, 479 bp, Homo sapiens
  misc_feature: HIJSMM301ELU89.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgtcgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaaacgaactagtggctgcaccat

SEQ ID NO: 585328 - DNA, 488 bp, Homo sapiens
  misc_feature: HIJSMM301E2WGO.41.44.D11.1.454.light.4.raw
  modified_base (397)..(397): a, c, t, g, unknown or other
tctatactatcacgaccggtgctcgatttagcgcagtacgaagggggctgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctggggtccagtttgnggatgaggctgactactattgcacggtctggtacagcagcgctgtggtcttcggcggagggactgaacttatcggtcctaggtcagcccaa

SEQ ID NO: 585329 - DNA, 509 bp, Homo sapiens
  misc_feature: HIJSMM301DXRNP.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccgaaggtggaagtcaagcgaactgtggctgcaccatctgtcttcatcttcccgccat

SEQ ID NO: 585330 - DNA, 490 bp, Homo sapiens; identical to SEQ ID NO: 559116
  misc_feature: HIJSMM301BV3HR.46.35.D02.1.454.light.4.raw

SEQ ID NO: 585331 - DNA, 513 bp, Homo sapiens
  misc_feature: HIJSMM301CPAGE.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatacagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggaccgtgtcacgacgaacgtaggaagtacaagacgaacgtacgtagtgtgtcgacctacactcgtcttccttatccttccgtt

SEQ ID NO: 585332 - DNA, 505 bp, Homo sapiens; identical to SEQ ID NO: 536117
  misc_feature: HIJSMM301AOZNW.8.71.G05.1.454.light.4.raw

SEQ ID NO: 585333 - DNA, 485 bp, Homo sapiens; identical to SEQ ID NO: 535501
  misc_feature: HIJSMM301BBZEM.3.10.A10.1.454.light.4.raw

SEQ ID NO: 585334 - DNA, 481 bp, Homo sapiens
  misc_feature: HIJSMM301EQMR5.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaataccctcggctcactttcggcgagggccaaggtgagatcaaacgaactgtggctgcacca

SEQ ID NO: 585335 - DNA, 477 bp, Homo sapiens; identical to SEQ ID NO: 569704
  misc_feature: HIJSMM301A9VC9.7.76.G10.1.454.light.4.raw

SEQ ID NO: 585336 - DNA, 484 bp, Homo sapiens
  misc_feature: HIJSMM301CKBWY.48.57.F02.1.454.light.4.raw
agtatacatacacgaccggtgctcgatttagctcgatatagttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaagg

SEQ ID NO: 585337 - DNA, 494 bp, Homo sapiens; identical to SEQ ID NO: 535629
  misc_feature: HIJSMM301EH23Z.4.27.C05.1.454.light.4.raw

SEQ ID NO: 585338 - DNA, 503 bp, Homo sapiens
  misc_feature: HIJSMM301C59IM.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgaccccaaactcctcatctctcacaataatcagcggccctcaggagtccctgaccgattctctgccctccaagtccggcacctcagccctccctggccatcagtgggctccggggccgaggatggaggctgattattactgtgcaggatgggatgacaacctgggtgcttatctcttcggacctgggaccaaggtcaccgtcctt

SEQ ID NO: 585339 - DNA, 508 bp, Homo sapiens; identical to SEQ ID NO: 541908
  misc_feature: HIJSMM301CKQ7Y.47.85.H08.1.454.light.4.raw

SEQ ID NO: 585340 - DNA, 490 bp, Homo sapiens; identical to SEQ ID NO: 543909
  misc_feature: HIJSMM301BO0RW.14.55.E11.1.454.light.4.raw

SEQ ID NO: 585341 - DNA, 485 bp, Homo sapiens; identical to SEQ ID NO: 540394
  misc_feature: HIJSMM301BE3I6.46.26.C04.1.454.light.4.raw

SEQ ID NO: 585342 - DNA, 521 bp, Homo sapiens
  misc_feature: HIJSMM301EYNKF.5.27.C05.1.454.light.4.raw
atcagacacgcacgaccggtgctcgatttagacgcgatcgaagggtttggggagtctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccaccctcctcccgt

SEQ ID NO: 585343 - DNA, 482 bp, Homo sapiens; identical to SEQ ID NO: 535920
  misc_feature: HIJSMM301EFEEC.19.71.G05.1.454.light.4.raw

SEQ ID NO: 585344 - DNA, 521 bp, Homo sapiens; identical to SEQ ID NO: 564470
  misc_feature: HIJSMM301CF3SF.41.19.B08.1.454.light.4.raw

SEQ ID NO: 585345 - DNA, 507 bp, Homo sapiens
  misc_feature: HIJSMM301AUFUK.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtcgtctgggtctcctggacagtcgatcaccatctcctgcactggaaccaacagtgacgttgatttttatatctctgtctcctggtaccaacaacacccaggcaaagcccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 585346 - DNA, 495 bp, Homo sapiens
  misc_feature: HIJSMM301B4939.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgaactggagattaaacgaactgtggctgcaccatctgtctt

SEQ ID NO: 585347 - DNA, 517 bp, Homo sapiens
  misc_feature: HIJSMM301CMXPU.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcggagggaccaggctgaccgtcctaggtcagccaaggctgcccctcggtcactctgttcccgcct

SEQ ID NO: 585348 - DNA, 504 bp, Homo sapiens; identical to SEQ ID NO: 536469
  misc_feature: HIJSMM301AHJFD.52.36.D03.1.454.light.4.raw

SEQ ID NO: 585349 - DNA, 486 bp, Homo sapiens
  misc_feature: HIJSMM301BCJH5.14.68.G02.1.454.light.4.raw
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgctcactttcggcggagggaccaaggtggacatcaaacgactgtggctgcaccat

SEQ ID NO: 585350 - DNA, 486 bp, Homo sapiens; identical to SEQ ID NO: 565503
  misc_feature: HIJSMM301EVSWR.3.10.A10.1.454.light.4.raw

SEQ ID NO: 585351 - DNA, 485 bp, Homo sapiens; identical to SEQ ID NO: 536040
  misc_feature: HIJSMM301DXNC3.15.1.A01.1.454.light.4.raw

SEQ ID NO: 585352 - DNA, 503 bp, Homo sapiens
  misc_feature: HIJSMM301CRV3S.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggggcagcgggtctgggacagatttcactctcaccatcaccaacctgcaggctgaagatgtggcagtttattactgtcagcaatactatagtcctcctctctacgttcggcggaggaccaaggtggagatacaaacgactgtggctgcaccatcctgtct

SEQ ID NO: 585353 - DNA, 516 bp, Homo sapiens; identical to SEQ ID NO: 559065
  misc_feature: HIJSMM301EEUX2.22.28.C06.1.454.light.4.raw

SEQ ID NO: 585354 - DNA, 385 bp, Homo sapiens; identical to SEQ ID NO: 580402
  misc_feature: HIJSMM301AHMBP.48.37.D04.1.454.light.4.raw

SEQ ID NO: 585355 - DNA, 448 bp, Homo sapiens
  misc_feature: HIJSMM301D59IJ.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccaaccctcctccatactcgta

SEQ ID NO: 585356 - DNA, 480 bp, Homo sapiens
  misc_feature: HIJSMM301CG26J.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtggggtcccatcgcggttcagcggcagtggatatgggacatatttcactctcgccatcagcagcctgcagcctgaagattttgcaacttactattgtcaacaggctaacagtttcccgctcaccttcggcgggggaccgaaggtggagatacaaacgaactgtggctgcacc

SEQ ID NO: 585357 - DNA, 478 bp, Homo sapiens
  misc_feature: HIJSMM301B0WER.13.6.A06.1.454.light.4.raw
tcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcgagggaccaagctgaccgtcctaggtcagcccaaggctgccccctcggtcactctcg

SEQ ID NO: 585358 - DNA, 494 bp, Homo sapiens; identical to SEQ ID NO: 534992
  misc_feature: HIJSMM301A5CXP.9.1.A01.1.454.light.4.raw

SEQ ID NO: 585359 - DNA, 517 bp, Homo sapiens; identical to SEQ ID NO: 546084
  misc_feature: HIJSMM301A90BG.47.53.E09.1.454.light.4.raw

SEQ ID NO: 585360 - DNA, 497 bp, Homo sapiens; identical to SEQ ID NO: 545672
  misc_feature: HIJSMM301ER76L.2.49.E05.1.454.light.4.raw

SEQ ID NO: 585361 - DNA, 497 bp, Homo sapiens; identical to SEQ ID NO: 545672
  misc_feature: HIJSMM301AYWAV.2.49.E05.1.454.light.4.raw

SEQ ID NO: 585362 - DNA, 528 bp, Homo sapiens
  misc_feature: HIJSMM301CEJX4.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggaagggaccaggctgaccgtcctaggtcagcccaaggctgccccctcggtcactcctgttccccgccctccc

SEQ ID NO: 585363 - DNA, 486 bp, Homo sapiens
  misc_feature: HIJSMM301B3UKP.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgcagggccagtcagaatattaataggtggttggcctggtatcagcagaaaccagggaaagcccctaaggtcctgatatatgagacttctactttagaaagtgggtcccatcaaggttcagcggcagtggatctgggacagaattcactctcactatcaccagcctgcaacctgatgattttgcaacttattactgccaacagtatcatcatcattgtaatttcggtggaggaccaaggtggaggtcaaacgaactgtggctgcaccatctgtcttc

SEQ ID NO: 585364 - DNA, 486 bp, Homo sapiens; identical to SEQ ID NO: 535385
  misc_feature: HIJSMM301DJ27I.19.71.G05.1.454.light.4.raw

SEQ ID NO: 585365 - DNA, 487 bp, Homo sapiens
  misc_feature: HIJSMM301AGWCP.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccagggggaccaaacctggatatcagacgaactgtgg

SEQ ID NO: 585366 - DNA, 496 bp, Homo sapiens; identical to SEQ ID NO: 540451
  misc_feature: HIJSMM301EGTF6.12.38.D05.1.454.light.4.raw

SEQ ID NO: 585367 - DNA, 505 bp, Homo sapiens
  misc_feature: HIJSMM301CCUPR.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccgagggtggaaagtacaaacgaactagtggctgcaccatctgtcttctatcttccccg

SEQ ID NO: 585368 - DNA, 500 bp, Homo sapiens
  misc_feature: HIJSMM301AODD3.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccgaagctgaccgtcctaggtcagcccaaggctgccccctcggtcact

SEQ ID NO: 585369 - DNA, 508 bp, Homo sapiens
  misc_feature: HIJSMM301BIKX4.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaggctgccccctcggtcactctgtt

SEQ ID NO: 585370 - DNA, 478 bp, Homo sapiens
  misc_feature: HIJSMM301A65LV.48.5.A05.1.454.light.4.raw
agtatacatacacgaccggtgctcgatttagatagatagacaggggggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgccaacagtattatacttatccatggacgttcggccaagggaccaaggtggaaatcaacgaaactgtggctgcaccat

SEQ ID NO: 585371 - DNA, 490 bp, Homo sapiens; identical to SEQ ID NO: 535936
  misc_feature: HIJSMM301A9TPI.16.68.G02.1.454.light.4.raw

SEQ ID NO: 585372 - DNA, 504 bp, Homo sapiens; identical to SEQ ID NO: 562185
  misc_feature: HIJSMM301EPWCQ.48.35.D02.1.454.light.4.raw

SEQ ID NO: 585373 - DNA, 489 bp, Homo sapiens; identical to SEQ ID NO: 536013
  misc_feature: HIJSMM301A7UHI.26.23.C01.1.454.light.4.raw

SEQ ID NO: 585374 - DNA, 486 bp, Homo sapiens
  misc_feature: HIJSMM301CSAYW.41.57.F02.1.454.light.4.raw
tctatactatcacgaccggtgctcgatttagctcgatatagttgggtttggggtccaaacagagcttcagcaagcatagtgggaatctgcaccatgccctgggctctgctcctcctgaccctcctcactcactctgcagtgtcagtggtccaggcaggactgactcagccaccctcggtgtccaagggcttgagacagaccgccacactcacctgcactgggaacagctacaatgttggcaacgaaggagcagcttggctgcagcagtaccagggccaccctcccaaattgctatcatacaggaagaacaaccgcccctcggggatctccgagagattctctgcatcaacgtcaggaaacatagcctccctgaccattactggactccagcctgaggacgaggctgactattactgctcagcatgggacagcagcctcaatgtttgggtgttcggcggagggaccaagctgacgtcctaggtcacg

SEQ ID NO: 585375 - DNA, 504 bp, Homo sapiens
  misc_feature: HIJSMM301C40W0.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtcaaacgaactgtggctgcaccatctgtcttctat

SEQ ID NO: 585376 - DNA, 503 bp, Homo sapiens; identical to SEQ ID NO: 539578
  misc_feature: HIJSMM301BGZJF.48.8.A08.1.454.light.4.raw

SEQ ID NO: 585377 - DNA, 465 bp, Homo sapiens; identical to SEQ ID NO: 538589
  misc_feature: HIJSMM301A268I.12.39.D06.1.454.light.4.raw

SEQ ID NO: 585378 - DNA, 495 bp, Homo sapiens
  misc_feature: HIJSMM301EKIP1.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatccaccttcggccaagggacacgactggagattaaacgaactgtggctgcaccatctgtcttcattcc

SEQ ID NO: 585379 - DNA, 441 bp, Homo sapiens; identical to SEQ ID NO: 535074
  misc_feature: HIJSMM301DHQ32.11.3.A03.1.454.light.4.raw

SEQ ID NO: 585380 - DNA, 498 bp, Homo sapiens
  misc_feature: HIJSMM301AUFHH.52.86.H09.1.454.light.4.raw
cgcagtacgacacgaccggtgctcgatttagtgctatagacttgggtttgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 585381 - DNA, 487 bp, Homo sapiens; identical to SEQ ID NO: 581839
  misc_feature: HIJSMM301C4BLM.21.4.A04.1.454.light.4.raw

SEQ ID NO: 585382 - DNA, 486 bp, Homo sapiens; identical to SEQ ID NO: 538568
  misc_feature: HIJSMM301D0AOT.47.38.D05.1.454.light.4.raw

SEQ ID NO: 585383 - DNA, 445 bp, Homo sapiens
  misc_feature: HIJSMM301CF5LZ.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttggggtgttcggcggagggaccaagctgaccgtcctaagtcagcccaaggctgccccctcggtcactctgttcccgccctcctccgtgtctgat

SEQ ID NO: 585384 - DNA, 471 bp, Homo sapiens
  misc_feature: HIJSMM301D5JH8.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggactcaggctatggatgaggctgactattactgtcaggcgtgggacagcagcactgcccgctatgtcttcggaactgggaccaaggtcaccgtcctaagtcacg

SEQ ID NO: 585385 - DNA, 509 bp, Homo sapiens; identical to SEQ ID NO: 571138
  misc_feature: HIJSMM301DGGL7.4.57.F02.1.454.light.4.raw

SEQ ID NO: 585386 - DNA, 515 bp, Homo sapiens
  misc_feature: HIJSMM301B0HIJ.48.17.B06.1.454.light.4.raw
agtatacatacacgaccggtgctcgatttagtcgatagtgaaggggtggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtcactctgttcccta

SEQ ID NO: 585387 - DNA, 484 bp, Homo sapiens
  misc_feature: HIJSMM301CKI1L.13.55.E11.1.454.light.4.raw
tcacgtactacacgaccggtgctcgatttagcactcgcacgttgggtttggggactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtgggtcccatcaaggttcagcggcagtggatctggcacagacttcattctcaccatcagcagcctgcagcctgaagattttgcaacttattactgtctacaagatcacaattatcctgggacgttcggccaagggaccaaggtaggaaatcaaacgaactcgtggctgcaccatctgttcttcta

SEQ ID NO: 585388 - DNA, 511 bp, Homo sapiens
  misc_feature: HIJSMM301CMKTR.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgacttattactgtgcatcaccggggacgcaacatggggatgacaatctggagcggttgggtgttcgggcggagggaccaaactggacccgtcctaggtcagccccaa

SEQ ID NO: 585389 - DNA, 486 bp, Homo sapiens
  misc_feature: HIJSMM301BT3CI.40.53.E09.1.454.light.4.raw
tctagcgactcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaa

SEQ ID NO: 585390 - DNA, 444 bp, Homo sapiens; identical to SEQ ID NO: 535192
  misc_feature: HIJSMM301EQAYA.5.9.A09.1.454.light.4.raw

SEQ ID NO: 585391 - DNA, 491 bp, Homo sapiens
  misc_feature: HIJSMM301CKIMK.10.17.B06.1.454.light.4.raw
catagtagtgcacgaccggtgctcgatttagtcgatagtgaagggggaggaactgctcagttaggacccagacggaaccatggaagccccagcgcagcttctcttcctcctgctactctggctcccagataccactggagaagtagtgatgacgcagtctccggccaccctgtctgtgtctccaggggaaagagtcaccctctcctgcagggccagtcagactattagtacaaacttggcctggtaccagcataaacctggccaggctcccaggctcctcatccatggtgcatcctccagggccactaatatcccagccaggttcagtggcagtgggtcgggtcagagttcactctcaccatcagcagcctgcagtctgaagattttgctagtttattactgtcagcaatatgatacctggcctccgtacacttttggccggggaccaagctggaatcaagcgaactgtggctgcaccatctgtcttcatt

SEQ ID NO: 585392 - DNA, 485 bp, Homo sapiens; identical to SEQ ID NO: 546308
  misc_feature: HIJSMM301CA71N.47.60.F05.1.454.light.4.raw

SEQ ID NO: 585393 - DNA, 501 bp, Homo sapiens
  misc_feature: HIJSMM301BJ7LU.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaacccac

SEQ ID NO: 585394 - DNA, 493 bp, Homo sapiens; identical to SEQ ID NO: 542565
  misc_feature: HIJSMM301CC0PL.48.71.G05.1.454.light.4.raw

SEQ ID NO: 585395 - DNA, 479 bp, Homo sapiens; identical to SEQ ID NO: 535118
  misc_feature: HIJSMM301B4S76.13.59.F04.1.454.light.4.raw

SEQ ID NO: 585396 - DNA, 506 bp, Homo sapiens
  misc_feature: HIJSMM301DI6IY.7.87.H10.1.454.light.4.raw
cgtgtctctacacgaccggtgctcgatttagcagtactgcgttgggtttggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccaagggaccaaggtggaagtcaaacgaactagtggctgcaccatctgtcttcatcttcccgccact

SEQ ID NO: 585397 - DNA, 489 bp, Homo sapiens; identical to SEQ ID NO: 535139
  misc_feature: HIJSMM301ERVEO.14.55.E11.1.454.light.4.raw

SEQ ID NO: 585398 - DNA, 489 bp, Homo sapiens
  misc_feature: HIJSMM301DA32B.17.26.C04.1.454.light.4.raw
cgtagactagcacgaccggtgctcgatttagtctagcgactttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggaggatcaaacgaactgtggctgcacccta

SEQ ID NO: 585399 - DNA, 473 bp, Homo sapiens; identical to SEQ ID NO: 546369
  misc_feature: HIJSMM301AE5ML.18.76.G10.1.454.light.4.raw

SEQ ID NO: 585400 - DNA, 497 bp, Homo sapiens; identical to SEQ ID NO: 545672
  misc_feature: HIJSMM301CNBBP.2.49.E05.1.454.light.4.raw

SEQ ID NO: 585401 - DNA, 495 bp, Homo sapiens
  misc_feature: HIJSMM301DFT1F.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccgaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtcccaagtaacttttcggccgaggggaccaagctggagatacaaacgaactgtggctgcaccatcttcg

SEQ ID NO: 585402 - DNA, 503 bp, Homo sapiens
  misc_feature: HIJSMM301AR1SJ.43.14.B03.1.454.light.4.raw
tgtgagtagtcacgaccggtgctcgatttagtgtgagtagttccgcggggggggtctcaggaggcagtgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcacttatgtcttcggaactgggaccaaggtcaccgacctaggtcagcccaaggccaaccccactgtca

SEQ ID NO: 585403 - DNA, 470 bp, Homo sapiens; identical to SEQ ID NO: 567417
  misc_feature: HIJSMM301AK5IU.49.4.A04.1.454.light.4.raw

SEQ ID NO: 585404 - DNA, 484 bp, Homo sapiens
  misc_feature: HIJSMM301DXOX9.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacagggtcccatcaaggttcagtggaagtggatctgggacagattttactttcaccatcagcagcctgcagcctgaagatattgcaacatattactgtcaacagtatcataatctccccactttcggcctggaccaaacgtggatatcaaacgaactgtggctgcaccatctgtt

SEQ ID NO: 585405 - DNA, 486 bp, Homo sapiens; identical to SEQ ID NO: 535043
  misc_feature: HIJSMM301E13UQ.46.35.D02.1.454.light.4.raw

SEQ ID NO: 585406 - DNA, 502 bp, Homo sapiens
  misc_feature: HIJSMM301B878I.43.55.E11.1.454.light.4.raw
tgtgagtagtcacgaccggtgctcgatttagcactcgcacgttgggtttgggggagtcagacccagtcaggacacagcatggacatgagggtccccgctcagctcctggggctcctgctgctctggctcccaggtgccaaatgtgacatccagatgacccagtctccttccaccctgtctggatctgtaggagacagagtcaccatcacttgccgggccagtcagagtattagtagctggttggcctggtatcagcagaaaccagggaaagcccctaggttcctgatctataaggcatctaatttagaaagtggggtcccattaaggttcagcggcagtggatctgggacagagtttactctcaccatcagcagcctgcagcctgatgattttgcaacttattactgccaacaatatgattcttggccgtggacgttcggtccaagggaccgaacgtggaaagtacaaacgaaactagtggctgcaccactctgtcttcatt

SEQ ID NO: 585407 - DNA, 503 bp, Homo sapiens
  misc_feature: HIJSMM301BY6J8.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcgggagggaccaaactgaccgtcctaggtcagccaaggctcgccccctc

SEQ ID NO: 585408 - DNA, 498 bp, Homo sapiens
  misc_feature: HIJSMM301BVMNL.15.25.C03.1.454.light.4.raw
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctcggggtccctgacaggttcagtggcagtggatcaggcatagattttacactgaaaatcagcagagtggaggctgaggacgttggggtttattactgcatgcaaggtctacaaaccccgatcaccttcggccgagggacacgcctggagattaaacgaactgtggctgcgaccat

SEQ ID NO: 585409 - DNA, 466 bp, Homo sapiens; identical to SEQ ID NO: 535366
  misc_feature: HIJSMM301DT5WJ.13.4.A04.1.454.light.4.raw

SEQ ID NO: 585410 - DNA, 503 bp, Homo sapiens
  misc_feature: HIJSMM301EJNUU.48.60.F05.1.454.light.4.raw
agtatacatacacgaccggtgctcgatttagtacgtcatcagggaaagggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccggggaccaacgtggaaatcaaacgaactgtggctgcaccatctgtctt

SEQ ID NO: 585411 - DNA, 383 bp, Homo sapiens; identical to SEQ ID NO: 559179
  misc_feature: HIJSMM301DU2Z7.41.26.C04.1.454.light.4.raw

SEQ ID NO: 585412 - DNA, 493 bp, Homo sapiens
  misc_feature: HIJSMM301AY086.8.12.B01.1.454.light.4.raw
ctcgcgtgtccacgaccggtgctcgatttagtagtgtagattccgcggggctgggcctcaggaagcagcatcggaggtgcctcagccatggcatggatccctctcttcctcggcgtccttgcttactgcacaggatccgtggcctcctatgagctgactcagcccaccctcagtgtccgtcgtccccaggacagacagccaggatcacctgctctggagataaagttgggggataaatatgcttgctggtatcagcagaggccaggccagtcccctgtactggtcatctatcaagataacaagcggccctcagggatccctgagcgattctctggctccaactctgggaacacagccactctgaccatcagcgggacccaggctacggatgaggctgactattactgtcaggcgtgggacagcagcacctatgtggttttcggcggagggaccaagctgaccgtccttggtcagcccaaggctcgtccccccg

SEQ ID NO: 585413 - DNA, 485 bp, Homo sapiens
  misc_feature: HIJSMM301EE6PK.48.4.A04.1.454.light.4.raw
agtatacatacacgaccggtgctcgatttagagtagtgatcaggggagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaaggaccgacgggtggaaagtacaaacgaaactagtggctgcaccatctgtcttc

SEQ ID NO: 585414 - DNA, 504 bp, Homo sapiens; identical to SEQ ID NO: 539091
  misc_feature: HIJSMM301CG3E6.8.28.C06.1.454.light.4.raw

SEQ ID NO: 585415 - DNA, 511 bp, Homo sapiens; identical to SEQ ID NO: 570184
  misc_feature: HIJSMM301BXD0B.17.33.C11.1.454.light.4.raw

SEQ ID NO: 585416 - DNA, 488 bp, Homo sapiens; identical to SEQ ID NO: 542971
  misc_feature: HIJSMM301BHIDO.40.20.B09.1.454.light.4.raw

SEQ ID NO: 585417 - DNA, 486 bp, Homo sapiens; identical to SEQ ID NO: 535043
  misc_feature: HIJSMM301A3L2M.46.35.D02.1.454.light.4.raw

SEQ ID NO: 585418 - DNA, 506 bp, Homo sapiens; identical to SEQ ID NO: 555851
  misc_feature: HIJSMM301D4C0K.19.78.H01.1.454.light.4.raw

SEQ ID NO: 585419 - DNA, 469 bp, Homo sapiens
  misc_feature: HIJSMM301CPLC7.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgatttgctcctccgagtgccacttttggcgggggaccaaggtggacatcaaacga

SEQ ID NO: 585420 - DNA, 497 bp, Homo sapiens
  misc_feature: HIJSMM301A4UZ2.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccgaaggtcggagatacaaacgaact

SEQ ID NO: 585421 - DNA, 380 bp, Homo sapiens
  misc_feature: HIJSMM301COR3W.12.78.H01.1.454.light.4.raw
atacgacgtacacgaccggtgctcgatttagtgtgagtagtttgggtttgggggccgttcctggaagcagctccaacatcggaagtaatactgtaaactggtaccagcagctcccaggaacggcccccaaactcctcatctatagtaataatcagcgaccctcaggggtccctgaccgattctctggctccaagtctggcacctcagcctccctggccatcagtgggctccagtctgaggatgaggctgattattactgtgcagcatgggatgacagcctgaatggtccggtattcggcggagggaccaagctgaccgtcctaggtcagcccaaggctgccccctcggtcactctgttcccgccctcctctacgtcgtat

SEQ ID NO: 585422 - DNA, 506 bp, Homo sapiens
  misc_feature: HIJSMM301DWZAJ.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaaccccactgt

SEQ ID NO: 585423 - DNA, 505 bp, Homo sapiens; identical to SEQ ID NO: 539292
  misc_feature: HIJSMM301EUHGE.19.85.H08.1.454.light.4.raw

SEQ ID NO: 585424 - DNA, 493 bp, Homo sapiens
  misc_feature: HIJSMM301C5K8S.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggattttgcagtgtattactgtcagcagtatcataggtcaaacaccttcggccaagggacacgactggagattaaaggaactgtggctgcacatctgtctcatcttccccg

SEQ ID NO: 585425 - DNA, 491 bp, Homo sapiens
  misc_feature: HIJSMM301C6FH8.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgctactttattactgtcagcagcgtagcaactggcctctcactttcggcggagggaccagggtggagatcagacgaactgtggctgcaccatctgt

SEQ ID NO: 585426 - DNA, 518 bp, Homo sapiens; identical to SEQ ID NO: 545878
  misc_feature: HIJSMM301ASANK.41.25.C03.1.454.light.4.raw

SEQ ID NO: 585427 - DNA, 484 bp, Homo sapiens
  misc_feature: HIJSMM301E0M5L.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctggaaactaacgaactagtgctgcacca

SEQ ID NO: 585428 - DNA, 483 bp, Homo sapiens
  misc_feature: HIJSMM301A19D0.48.10.A10.1.454.light.4.raw
agtatacatacacgaccggtgctcgatttagcgtcgatctcagggggcaggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaagggaccaggtggaaatacaaacgaactagtggcgtgcaccat

SEQ ID NO: 585429 - DNA, 494 bp, Homo sapiens; identical to SEQ ID NO: 542031
  misc_feature: HIJSMM301DG0UP.12.23.C01.1.454.light.4.raw

SEQ ID NO: 585430 - DNA, 503 bp, Homo sapiens
  misc_feature: HIJSMM301B8WA4.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatggacaacctgggtgcttatctcttcggacctgggaccaaggtcaccgtcttggt

SEQ ID NO: 585431 - DNA, 494 bp, Homo sapiens
  misc_feature: HIJSMM301CD56J.49.58.F03.1.454.light.4.raw
agtcgagagacacgaccggtgctcgatttagtctgatcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccaggttcagtggcagtgggttgggacagacttcacgctcaccatcagcagcctagagcctgaagattttgcagtttattactgtcaacagcgtaccacaggattcactttcggccctgggaccagagtggatatcaaacgaactgtggctgcaccatctgtcttcatcttccccg

SEQ ID NO: 585432 - DNA, 482 bp, Homo sapiens; identical to SEQ ID NO: 540508
  misc_feature: HIJSMM301AO7XZ.43.64.F09.1.454.light.4.raw

SEQ ID NO: 585433 - DNA, 513 bp, Homo sapiens
  misc_feature: HIJSMM301ANZ76.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtccagcccaaggccaaccccactgtcactctcg

SEQ ID NO: 585434 - DNA, 447 bp, Homo sapiens; identical to SEQ ID NO: 535020
  misc_feature: HIJSMM301D0VUG.18.9.A09.1.454.light.4.raw

SEQ ID NO: 585435 - DNA, 502 bp, Homo sapiens
  misc_feature: HIJSMM301CKT39.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactgtggctgcaccatctgtcttcatctcccgcc

SEQ ID NO: 585436 - DNA, 497 bp, Homo sapiens; identical to SEQ ID NO: 536376
  misc_feature: HIJSMM301D9PO6.22.9.A09.1.454.light.4.raw

SEQ ID NO: 585437 - DNA, 497 bp, Homo sapiens
  misc_feature: HIJSMM301EHW88.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaattattatattcctcctcagacgttcggccaagggaccaaggtggaaatcaaacgaactgtggctgcacc

SEQ ID NO: 585438 - DNA, 523 bp, Homo sapiens
  misc_feature: HIJSMM301BSINT.41.19.B08.1.454.light.4.raw
tctatactatcacgaccggtgctcgatttagtgagtcagtaaggggggggtcgtcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgacccatctccggcctccaggcggaggacgagggtgattatttctgcagctcatttacaaccagccacaccttgctcttcggaactgggaccacggtcatcgtcctaggtcagcccaaggccaacccccactgtcactctgttcccgccctcctcat

SEQ ID NO: 585439 - DNA, 507 bp, Homo sapiens
  misc_feature: HIJSMM301CR4FF.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccggggccactttcggccctgggaccaaggtggagatcaaacgaactgtggctgcaccatctgtcttcta

SEQ ID NO: 585440 - DNA, 506 bp, Homo sapiens; identical to SEQ ID NO: 534969
  misc_feature: HIJSMM301CQRW1.18.37.D04.1.454.light.4.raw

SEQ ID NO: 585441 - DNA, 508 bp, Homo sapiens; identical to SEQ ID NO: 545298
  misc_feature: HIJSMM301DFY0Z.8.42.D09.1.454.light.4.raw

SEQ ID NO: 585442 - DNA, 516 bp, Homo sapiens; identical to SEQ ID NO: 567116
  misc_feature: HIJSMM301ER6W6.40.87.H10.1.454.light.4.raw

SEQ ID NO: 585443 - DNA, 491 bp, Homo sapiens
  misc_feature: HIJSMM301EHN57.51.81.H04.1.454.light.4.raw
cgatcgtatacacgaccggtgctcgatttagtagtgtagattcgcggggtgtgggtccaggaggcagaactctgggtgtctcaccatggcctggatccctctacttctccccctcctcactctctgcacaggctctgatgcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccactgtcta

SEQ ID NO: 585444 - DNA, 476 bp, Homo sapiens
  misc_feature: HIJSMM301B45GA.3.82.H05.1.454.light.4.raw
agacgcactccacgaccggtgctcgatttagtcgagctctctcgcgggggagtcagacccagtcaggacacagcatggacatgagggtccccgctcagctcctggggctcctgctgctctggttcccaggttccagatgcgacatccagatgacccagtctccatcctccgtgtctgcatctgtaggggacagagtcgctatgacttgtcgggcgactcgtggttttaacagatggttagtctggtatcagcagaaaccagggaaagcccctgagttcctgatgtctgctgcatccaccctgcaaagtggagtcccatccagattcagcgtcagtgaatctgggacagagttcactctcaccatcagcagcctgcagcctgaagattttgcaacttactattgtcaacaggctgacagtctcccgctcactttcggcggagggaccaaggtggagatcaaacgaactgtggctgca

SEQ ID NO: 585445 - DNA, 491 bp, Homo sapiens
  misc_feature: HIJSMM301BYLVP.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaacgcccctgacctcctgatctatgctgcatccagtttgcacagtggggtcccgtcaaggttcagtggcagtggatctgggacagatttcactctcaccgtcagcagtctgcaacctgaagattttgctaacttactactgtcaacagagttacacgtacccccctcactttcggcggaggaccaaggcggagatcagacgaactgtggctgcaccatctgtcttcta

SEQ ID NO: 585446 - DNA, 500 bp, Homo sapiens
  misc_feature: HIJSMM301AYCI1.41.45.E01.1.454.light.4.raw
tctatactatcacgaccggtgctcgatttagtgagtcagtaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgccccctcggtcactctcg

SEQ ID NO: 585447 - DNA, 494 bp, Homo sapiens; identical to SEQ ID NO: 534992
  misc_feature: HIJSMM301A9NU2.9.1.A01.1.454.light.4.raw

SEQ ID NO: 585448 - DNA, 493 bp, Homo sapiens; identical to SEQ ID NO: 537281
  misc_feature: HIJSMM301DDFAZ.9.1.A01.1.454.light.4.raw

SEQ ID NO: 585449 - DNA, 468 bp, Homo sapiens
  misc_feature: HIJSMM301DA0BL.3.70.G04.1.454.light.4.raw
agacgcactccacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagtgttagcagctatttaaattggtatcagcagaaaccagggaaagcccctaagctcctgatctatgctgcatccactttgcatggtggggtcccatcaagcttcagtggcagtggatctgggacagatttcactctcaccatcagcaatctgcaacctgaagattttgcaacttactactgtcaacagagttacagtacccctccgacttttggccaggggaccaagctggagatcaaacgaa

SEQ ID NO: 585450 - DNA, 500 bp, Homo sapiens
  misc_feature: HIJSMM301ET7YP.52.55.E11.1.454.light.4.raw
cgcagtacgacacgaccggtgctcgatttagcactcgcacgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtcttcatt

SEQ ID NO: 585451 - DNA, 505 bp, Homo sapiens
  misc_feature: HIJSMM301DXXMF.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtcact

SEQ ID NO: 585452 - DNA, 489 bp, Homo sapiens
  misc_feature: HIJSMM301BRFO7.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccgaagggaccgaaggtggaactcaaacgaa

SEQ ID NO: 585453 - DNA, 495 bp, Homo sapiens; identical to SEQ ID NO: 536055
  misc_feature: HIJSMM301CTDYH.47.38.D05.1.454.light.4.raw

SEQ ID NO: 585454 - DNA, 486 bp, Homo sapiens; identical to SEQ ID NO: 535043
  misc_feature: HIJSMM301EKMLP.46.35.D02.1.454.light.4.raw

SEQ ID NO: 585455 - DNA, 523 bp, Homo sapiens
  misc_feature: HIJSMM301BHKP0.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgcaaactacacacggccgctcactttcggcgggagggaccaaggtggaggtacgtaacgaaacgtaacgtggtcgtgtcgaccactactcgtgtt

SEQ ID NO: 585456 - DNA, 485 bp, Homo sapiens; identical to SEQ ID NO: 536040
  misc_feature: HIJSMM301BOU3Y.15.1.A01.1.454.light.4.raw

SEQ ID NO: 585457 - DNA, 328 bp, Homo sapiens; identical to SEQ ID NO: 541074
  misc_feature: HIJSMM301E3IEF.8.71.G05.1.454.light.4.raw

SEQ ID NO: 585458 - DNA, 490 bp, Homo sapiens; identical to SEQ ID NO: 539196
  misc_feature: HIJSMM301DGY61.22.65.F10.1.454.light.4.raw

SEQ ID NO: 585459 - DNA, 464 bp, Homo sapiens
  misc_feature: HIJSMM301EHH54.48.73.G07.1.454.light.4.raw
agtatacatacacgaccggtgctcgatttagctctacgctcagggcacgaccggtgctcgatttagacgacagctcagggcacgaccggtgctcgatttagactcatctacagggggcaggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagatttgcgta

SEQ ID NO: 585460 - DNA, 494 bp, Homo sapiens; identical to SEQ ID NO: 534992
  misc_feature: HIJSMM301CQTFO.9.1.A01.1.454.light.4.raw

SEQ ID NO: 585461 - DNA, 496 bp, Homo sapiens; identical to SEQ ID NO: 536690
  misc_feature: HIJSMM301C93OT.40.23.C01.1.454.light.4.raw

SEQ ID NO: 585462 - DNA, 485 bp, Homo sapiens
  misc_feature: HIJSMM301C8RXI.5.39.D06.1.454.light.4.raw
atcagacacgcacgaccggtgctcgatttagtgacatctcgcagttctttggggagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaaatgagacgaactgtggctgcaccatctgtctt

SEQ ID NO: 585463 - DNA, 492 bp, Homo sapiens
  misc_feature: HIJSMM301AG0N3.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcaggcgggtctgggacagatttcactctcaccatcagcagcctgcaggctgaagatgtggcagtttattactgtcagcaattattctactactcctcggtactttcggcggagggaccgaaggtaggagatcaaacgaac

SEQ ID NO: 585464 - DNA, 481 bp, Homo sapiens; identical to SEQ ID NO: 560621
  misc_feature: HIJSMM301D7ZN6.41.34.D01.1.454.light.4.raw

SEQ ID NO: 585465 - DNA, 444 bp, Homo sapiens; identical to SEQ ID NO: 534993
  misc_feature: HIJSMM301BZWV8.5.9.A09.1.454.light.4.raw

SEQ ID NO: 585466 - DNA, 502 bp, Homo sapiens; identical to SEQ ID NO: 543172
  misc_feature: HIJSMM301BT7MF.18.59.F04.1.454.light.4.raw

SEQ ID NO: 585467 - DNA, 501 bp, Homo sapiens; identical to SEQ ID NO: 536142
  misc_feature: HIJSMM301BU9Y9.15.1.A01.1.454.light.4.raw

SEQ ID NO: 585468 - DNA, 440 bp, Homo sapiens; identical to SEQ ID NO: 578848
  misc_feature: HIJSMM301DI8QY.11.3.A03.1.454.light.4.raw

SEQ ID NO: 585469 - DNA, 507 bp, Homo sapiens
  misc_feature: HIJSMM301D7ZGV.9.53.E09.1.454.light.4.raw
tgatacgtctcacgaccggtgctcgatttagagagagtgtgttgggtttggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatggttgggattatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccggtcctaggtcagcccaagggcctcgtccccccg

SEQ ID NO: 585470 - DNA, 493 bp, Homo sapiens
  misc_feature: HIJSMM301BLS47.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagccctaaggtcctgatctatggtgcatccattttgcaaagtggggtcccaccaaatttcagtggcagtggatctgggacagatttcactctcagcattaataatctgcaacctgaggtatttgcaacttactactgtcaacagagttacacggcccccctattacttttggtccgaggggaccaagctggagatcacaggaactggtggctgcacattc

SEQ ID NO: 585471 - DNA, 503 bp, Homo sapiens
  misc_feature: HIJSMM301EFBUF.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcagggtttctaatcgcttctctgctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 585472 - DNA, 490 bp, Homo sapiens; identical to SEQ ID NO: 538273
  misc_feature: HIJSMM301B66JL.16.73.G07.1.454.light.4.raw

SEQ ID NO: 585473 - DNA, 506 bp, Homo sapiens
  misc_feature: HIJSMM301CBLX3.15.86.H09.1.454.light.4.raw
  modified_base (501)..(501): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctggtcactctgttcccactcctcncgtct

SEQ ID NO: 585474 - DNA, 520 bp, Homo sapiens; identical to SEQ ID NO: 535773
  misc_feature: HIJSMM301AHWGW.41.19.B08.1.454.light.4.raw

SEQ ID NO: 585475 - DNA, 508 bp, Homo sapiens
  misc_feature: HIJSMM301AZ99W.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccactttcggccctgggaccaaagtggatatacaaacgaaactgtggctgcaccatctgtctt

SEQ ID NO: 585476 - DNA, 493 bp, Homo sapiens; identical to SEQ ID NO: 540903
  misc_feature: HIJSMM301DPOZN.10.20.B09.1.454.light.4.raw

SEQ ID NO: 585477 - DNA, 517 bp, Homo sapiens; identical to SEQ ID NO: 536980
  misc_feature: HIJSMM301BIIK3.5.27.C05.1.454.light.4.raw

SEQ ID NO: 585478 - DNA, 505 bp, Homo sapiens; identical to SEQ ID NO: 535503
  misc_feature: HIJSMM301CQZI5.8.28.C06.1.454.light.4.raw

SEQ ID NO: 585479 - DNA, 496 bp, Homo sapiens; identical to SEQ ID NO: 553382
  misc_feature: HIJSMM301A1133.51.59.F04.1.454.light.4.raw

SEQ ID NO: 585480 - DNA, 447 bp, Homo sapiens; identical to SEQ ID NO: 535020
  misc_feature: HIJSMM301B8NKB.18.9.A09.1.454.light.4.raw

SEQ ID NO: 585481 - DNA, 454 bp, Homo sapiens; identical to SEQ ID NO: 535005
  misc_feature: HIJSMM301BHEIN.19.86.H09.1.454.light.4.raw

SEQ ID NO: 585482 - DNA, 511 bp, Homo sapiens
  misc_feature: HIJSMM301BUOKO.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtcccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctcgccccctggtcactctcgttcccgccctcctcgctacgt

SEQ ID NO: 585483 - DNA, 473 bp, Homo sapiens; identical to SEQ ID NO: 535262
  misc_feature: HIJSMM301B2BT0.8.67.G01.1.454.light.4.raw

SEQ ID NO: 585484 - DNA, 509 bp, Homo sapiens
  misc_feature: HIJSMM301EH4D2.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcactcttcccgcc

SEQ ID NO: 585485 - DNA, 499 bp, Homo sapiens
  misc_feature: HIJSMM301A8F46.40.23.C01.1.454.light.4.raw
tctagcgactcacgaccggtgctcgatttagtacacgtgattagggattgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcat

SEQ ID NO: 585486 - DNA, 506 bp, Homo sapiens
  misc_feature: HIJSMM301A2QT3.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccaaaatagaggtcaaacgaactgtggctgcaccatctcgtcttcattcc

SEQ ID NO: 585487 - DNA, 498 bp, Homo sapiens
  misc_feature: HIJSMM301B2UMH.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaaccgaccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctggaccaaggtcaccgtctt

SEQ ID NO: 585488 - DNA, 487 bp, Homo sapiens; identical to SEQ ID NO: 541444
  misc_feature: HIJSMM301C2PBX.19.71.G05.1.454.light.4.raw

SEQ ID NO: 585489 - DNA, 491 bp, Homo sapiens; identical to SEQ ID NO: 547543
  misc_feature: HIJSMM301EJWOU.40.11.A11.1.454.light.4.raw

SEQ ID NO: 585490 - DNA, 487 bp, Homo sapiens; identical to SEQ ID NO: 544685
  misc_feature: HIJSMM301B45AB.15.28.C06.1.454.light.4.raw

SEQ ID NO: 585491 - DNA, 505 bp, Homo sapiens; identical to SEQ ID NO: 536117
  misc_feature: HIJSMM301AKYT4.8.71.G05.1.454.light.4.raw

SEQ ID NO: 585492 - DNA, 488 bp, Homo sapiens
  misc_feature: HIJSMM301CWYUJ.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgattatttattctcagcgttcggccgagggaccaaggtggaagtcaagcgaactgtggctgcacatctgtt

SEQ ID NO: 585493 - DNA, 494 bp, Homo sapiens; identical to SEQ ID NO: 534992
  misc_feature: HIJSMM301B5QBP.9.1.A01.1.454.light.4.raw

SEQ ID NO: 585494 - DNA, 491 bp, Homo sapiens
  misc_feature: HIJSMM301CPJ95.22.57.F02.1.454.light.4.raw
acatacgcgtcacgaccggtgctcgatttagctcgatatagttgggtttgggggagtcagacccagtcaggacacagcatggacatgagggtccccgctcagctcctgggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttatcggtcaccttcggccaagggacacgactggagattaaacgaactgtggctgcacatctgtcttcat

SEQ ID NO: 585495 - DNA, 503 bp, Homo sapiens; identical to SEQ ID NO: 562022
  misc_feature: HIJSMM301D99VB.21.81.H04.1.454.light.4.raw

SEQ ID NO: 585496 - DNA, 511 bp, Homo sapiens
  misc_feature: HIJSMM301A6Y0Z.17.33.C11.1.454.light.4.raw
cgtagactagcacgaccggtgctcgatttagagtgagctcgttgggtttggggctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactcgttcccgccct

SEQ ID NO: 585497 - DNA, 385 bp, Homo sapiens
  misc_feature: HIJSMM301D1H1N.41.26.C04.1.454.light.4.raw
tctatactatcacgaccggtgctcgatttagtctagcgactttggggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtactggtagttcacctctaactttcggcggagggaccaaggtggagatcaaacgaactgtggctgcaccatctgtcttcatcttcccgccatctgaatagtataga

SEQ ID NO: 585498 - DNA, 486 bp, Homo sapiens; identical to SEQ ID NO: 535043
  misc_feature: HIJSMM301BCSCF.46.35.D02.1.454.light.4.raw

SEQ ID NO: 585499 - DNA, 507 bp, Homo sapiens; identical to SEQ ID NO: 539466
  misc_feature: HIJSMM301A7VJC.8.33.C11.1.454.light.4.raw

SEQ ID NO: 585500 - DNA, 486 bp, Homo sapiens; identical to SEQ ID NO: 536261
  misc_feature: HIJSMM301E2MRN.26.55.E11.1.454.light.4.raw

SEQ ID NO: 585501 - DNA, 492 bp, Homo sapiens
  misc_feature: HIJSMM301CZ3EF.41.22.B11.1.454.light.4.raw
tctatactatcacgaccggtgctcgatttagacgacagctcaggggagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgtcggtccaagggaccgaggtaggaaagtacaagcgaactagtggctgcaccactctgtctt

SEQ ID NO: 585502 - DNA, 503 bp, Homo sapiens
  misc_feature: HIJSMM301C7Q1F.27.78.H01.1.454.light.4.raw
  modified_base (431)..(431): a, c, t, g, unknown or other
  modified_base (495)..(495): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttnttactgtcatcagagtactactttacctcaagtgatcaccttcggccaagggacacgactgganattaaacg

SEQ ID NO: 585503 - DNA, 506 bp, Homo sapiens
  misc_feature: HIJSMM301CGELM.9.12.B01.1.454.light.4.raw
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttccncgggcgttcggccaagggaccaacggtaggaaatacaacgaactagtggctgcaccatctgtcttcatcttccccg

SEQ ID NO: 585504 - DNA, 495 bp, Homo sapiens; identical to SEQ ID NO: 538920
  misc_feature: HIJSMM301DJP2M.47.64.F09.1.454.light.4.raw

SEQ ID NO: 585505 - DNA, 489 bp, Homo sapiens; identical to SEQ ID NO: 535139
  misc_feature: HIJSMM301DWBOO.14.55.E11.1.454.light.4.raw

SEQ ID NO: 585506 - DNA, 454 bp, Homo sapiens; identical to SEQ ID NO: 536347
  misc_feature: HIJSMM301D6DSO.19.86.H09.1.454.light.4.raw

SEQ ID NO: 585507 - DNA, 505 bp, Homo sapiens
  misc_feature: HIJSMM301A1RNW.10.29.C07.1.454.light.4.raw
catagtagtgcacgaccggtgctcgatttagagtgctacgaagggaaaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacaacacccaggcaaagcccccaaactcatgatttttgatgtcagtaatcggccctcaggggtttctaatcgcttctctggctccaagtctggcaacacggcctccctgaccatctctgggctccaggctgaggacgaggctgattattactgcagctcatatacaaccagcagcacttctgtattcggcggagggaccaagctgaccgtcctaggtcagcccaaggctgccccctcggtca

SEQ ID NO: 585508 - DNA, 504 bp, Homo sapiens
  misc_feature: HIJSMM301DUYMS.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcggggcaattggccgctcactttcggcgggggaccaaggtggagttcaaacgaactgtggctgcaccatctgtcttcatcttcccgccta

SEQ ID NO: 585509 - DNA, 501 bp, Homo sapiens; identical to SEQ ID NO: 536142
  misc_feature: HIJSMM301D4EWX.15.1.A01.1.454.light.4.raw

SEQ ID NO: 585510 - DNA, 479 bp, Homo sapiens
  misc_feature: HIJSMM301EUG5M.11.11.A11.1.454.light.4.raw
  modified_base (408)..(408): a, c, t, g, unknown or other
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggcagttttattactgtcagcagtattgngaagctccgctcactttcggcggagggaccgcggtgaggatcagacgaactgtggctgcaccatctgtctt

SEQ ID NO: 585511 - DNA, 506 bp, Homo sapiens
  misc_feature: HIJSMM301C6S35.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggagtatcaaacgaacctgtggctgcaccatctgtt

SEQ ID NO: 585512 - DNA, 486 bp, Homo sapiens; identical to SEQ ID NO: 551175
  misc_feature: HIJSMM301BF2HW.41.33.C11.1.454.light.4.raw

SEQ ID NO: 585513 - DNA, 488 bp, Homo sapiens
  misc_feature: HIJSMM301BUVG8.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccgggaccaaggtggatctcaaaagaactgtggctgcacc

SEQ ID NO: 585514 - DNA, 496 bp, Homo sapiens; identical to SEQ ID NO: 535109
  misc_feature: HIJSMM301DIXDE.16.78.H01.1.454.light.4.raw

SEQ ID NO: 585515 - DNA, 489 bp, Homo sapiens; identical to SEQ ID NO: 544329
  misc_feature: HIJSMM301AJ4O5.11.28.C06.1.454.light.4.raw

SEQ ID NO: 585516 - DNA, 524 bp, Homo sapiens
  misc_feature: HIJSMM301BSZGT.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccctccc

SEQ ID NO: 585517 - DNA, 513 bp, Homo sapiens; identical to SEQ ID NO: 551843
  misc_feature: HIJSMM301A907M.15.76.G10.1.454.light.4.raw

SEQ ID NO: 585518 - DNA, 517 bp, Homo sapiens
  misc_feature: HIJSMM301DIGVH.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccgaaggaccgaacggtaggaaggtacgaaaccgaactacgttggctgcgaccatctgtcttcatcttcccgcccact

SEQ ID NO: 585519 - DNA, 497 bp, Homo sapiens; identical to SEQ ID NO: 549756
  misc_feature: HIJSMM301EG8UR.40.57.F02.1.454.light.4.raw

SEQ ID NO: 585520 - DNA, 496 bp, Homo sapiens; identical to SEQ ID NO: 539427
  misc_feature: HIJSMM301ESXGT.43.42.D09.1.454.light.4.raw

SEQ ID NO: 585521 - DNA, 496 bp, Homo sapiens; identical to SEQ ID NO: 535660
  misc_feature: HIJSMM301CQ50P.43.25.C03.1.454.light.4.raw

SEQ ID NO: 585522 - DNA, 484 bp, Homo sapiens; identical to SEQ ID NO: 535400
  misc_feature: HIJSMM301A7XEP.46.26.C04.1.454.light.4.raw

SEQ ID NO: 585523 - DNA, 511 bp, Homo sapiens
  misc_feature: HIJSMM301BCBI3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcgtccacggacgaacggtaggaaggtacaaacgaactagtggcgtgcaccatctgtcttctatcttccgtccact

SEQ ID NO: 585524 - DNA, 517 bp, Homo sapiens
  misc_feature: HIJSMM301CTHR2.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtccgggggccgactttccggtcccgtcgggaccgaaacggtagagtatacaaacgaactgtggctgcaccatctgtctt

SEQ ID NO: 585525 - DNA, 482 bp, Homo sapiens; identical to SEQ ID NO: 535697
  misc_feature: HIJSMM301CG536.13.8.A08.1.454.light.4.raw

SEQ ID NO: 585526 - DNA, 495 bp, Homo sapiens; identical to SEQ ID NO: 535821
  misc_feature: HIJSMM301EVB6X.3.31.C09.1.454.light.4.raw

SEQ ID NO: 585527 - DNA, 506 bp, Homo sapiens
  misc_feature: HIJSMM301DMK3K.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccgactgtca

SEQ ID NO: 585528 - DNA, 506 bp, Homo sapiens; identical to SEQ ID NO: 560391
  misc_feature: HIJSMM301AHSZF.19.85.H08.1.454.light.4.raw

SEQ ID NO: 585529 - DNA, 513 bp, Homo sapiens; identical to SEQ ID NO: 545177
  misc_feature: HIJSMM301B8O99.8.23.C01.1.454.light.4.raw

SEQ ID NO: 585530 - DNA, 501 bp, Homo sapiens; identical to SEQ ID NO: 535746
  misc_feature: HIJSMM301EGH9C.18.11.A11.1.454.light.4.raw

SEQ ID NO: 585531 - DNA, 486 bp, Homo sapiens; identical to SEQ ID NO: 535043
  misc_feature: HIJSMM301E2PR9.46.35.D02.1.454.light.4.raw

SEQ ID NO: 585532 - DNA, 502 bp, Homo sapiens
  misc_feature: HIJSMM301CJTBT.48.34.D01.1.454.light.4.raw
agtatacatacacgaccggtgctcgatttagatcgtctgtgttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggcgtgccccccg

SEQ ID NO: 585533 - DNA, 508 bp, Homo sapiens; identical to SEQ ID NO: 537871
  misc_feature: HIJSMM301C3DOY.8.33.C11.1.454.light.4.raw

SEQ ID NO: 585534 - DNA, 484 bp, Homo sapiens; identical to SEQ ID NO: 535240
  misc_feature: HIJSMM301AX7VE.47.60.F05.1.454.light.4.raw

SEQ ID NO: 585535 - DNA, 489 bp, Homo sapiens
  misc_feature: HIJSMM301C3G0N.41.11.A11.1.454.light.4.raw
tctatactatcacgaccggtgctcgatttagctacgactgcaggggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagttttatttctgtcaccagtataaggactggccttggactttggctagggaccaagctggagatcagacgaactgtggctgcaccatctgtcttcta

SEQ ID NO: 585536 - DNA, 460 bp, Homo sapiens; identical to SEQ ID NO: 536053
  misc_feature: HIJSMM301BZBXG.22.28.C06.1.454.light.4.raw

SEQ ID NO: 585537 - DNA, 485 bp, Homo sapiens
  misc_feature: HIJSMM301BTJO8.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccacctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaacacagcctccctgaccattactggactccagcctgaggacgaggctgactattactgctcagcatgggacagcggcctcaggacttatgtcttcggaactgggacccacgttaccgtcctaggtcagccccg

SEQ ID NO: 585538 - DNA, 496 bp, Homo sapiens
  misc_feature: HIJSMM301EJ2E3.40.57.F02.1.454.light.4.raw
tctagcgactcacgaccggtgctcgatttagctcgatatagttgggtttgggggctggggtctcaggaggcagcactctcgggacgtctccaccatggcctgggctctgctcctcctcagcctcctcactcagggcataggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcagcccaac

SEQ ID NO: 585539 - DNA, 482 bp, Homo sapiens
  misc_feature: HIJSMM301A2TKW.4.29.C07.1.454.light.4.raw
agcactgtagcacgaccggtgctcgatttagagtgctacgaagggaaagggggctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccgaaggggccagggtggaaatcaaacgaactagtggctgcaccat

SEQ ID NO: 585540 - DNA, 482 bp, Homo sapiens; identical to SEQ ID NO: 548045
  misc_feature: HIJSMM301C3EF7.47.62.F07.1.454.light.4.raw

SEQ ID NO: 585541 - DNA, 507 bp, Homo sapiens
  misc_feature: HIJSMM301E1Q1J.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggcctgggaccaaagtggatatcaaacgaactgtggctgcaccatctgtcttcta

SEQ ID NO: 585542 - DNA, 496 bp, Homo sapiens; identical to SEQ ID NO: 537925
  misc_feature: HIJSMM301AFLB0.22.14.B03.1.454.light.4.raw

SEQ ID NO: 585543 - DNA, 508 bp, Homo sapiens; identical to SEQ ID NO: 543419
  misc_feature: HIJSMM301B182C.4.10.A10.1.454.light.4.raw

SEQ ID NO: 585544 - DNA, 505 bp, Homo sapiens
  misc_feature: HIJSMM301B0N0M.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgacttagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcggt

SEQ ID NO: 585545 - DNA, 506 bp, Homo sapiens; identical to SEQ ID NO: 576293
  misc_feature: HIJSMM301C12LU.18.37.D04.1.454.light.4.raw

SEQ ID NO: 585546 - DNA, 492 bp, Homo sapiens
  misc_feature: HIJSMM301BBP5M.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgcccccccgatccaccttcggccaagggacacgactggagattaaacgaactgtgctgcaccatctgtcttcatt

SEQ ID NO: 585547 - DNA, 488 bp, Homo sapiens
  misc_feature: HIJSMM301B4R4K.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaaacgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaactgt

SEQ ID NO: 585548 - DNA, 515 bp, Homo sapiens
  misc_feature: HIJSMM301DOXOU.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctacttactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggaggggaccaagctggccgtcctaggtcagcccaaggctgccccctcggtcactctgttcccaccctcctcgagtagtaca

SEQ ID NO: 585549 - DNA, 494 bp, Homo sapiens
  misc_feature: HIJSMM301B8SGG.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcgccaaggacacgactggagattaaaggaactagtggctgcaccaatctgtcttcatcttccccg

SEQ ID NO: 585550 - DNA, 493 bp, Homo sapiens
  misc_feature: HIJSMM301ER8IV.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatcaccttcggccaagggacacgactggagattaaacgaactgtggctgcaccatctgtcttcattcc

SEQ ID NO: 585551 - DNA, 515 bp, Homo sapiens
  misc_feature: HIJSMM301B1FB2.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccgggtccgaggatgaggctgattattactgtgcagcatgggatgacagcctgagtggtccttgggtgttcggcggagggaccaagctgaccgtctaagtcagcccaaggctgccccctcggtcactctgttcccaccctcctcg

SEQ ID NO: 585552 - DNA, 490 bp, Homo sapiens
  misc_feature: HIJSMM301C7TID.49.61.F06.1.454.light.4.raw
agtcgagagacacgaccggtgctcgatttagctacgctctaagggaaagggggagaagagctgctcagttaggacccagagggaaccatggaaaccccagcgcagcttctcttcctcctgctactctggctcccagataccaccgcagaaattgtgttgacgcagtctccaggcaccctgtctttgtctccaggggaaagagccaccctctcctgcagggccagtcagagcgttagcaacagttatgtagcctggtaccagcagaaacctggccagtctcccaggctcctcatctatgctgcgtccagcagggccactggcatcccggacaggttcagtggcagtgggtctgggacagacttctctctcaccatcagcagactggagcctgaagattttgcagtatattactgtcagcatgggagcattcgtgcgctcaccttcggcggagggaccaaggtggagatcaaacgaactgtggctgcaccta

SEQ ID NO: 585553 - DNA, 491 bp, Homo sapiens
  misc_feature: HIJSMM301DSRF7.52.82.H05.1.454.light.4.raw
cgcagtacgacacgaccggtgctcgatttagtcgagctctctcgcggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcact

SEQ ID NO: 585554 - DNA, 504 bp, Homo sapiens
  misc_feature: HIJSMM301A4OL9.13.36.D03.1.454.light.4.raw
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagtgtcaccatctcttgttctggaggcagtgccaacatcgggagtaattatgcattctggtatcaacaactcccaggaacggcccccagactcctcatctatagcaataaccagcggccctcaggggtccctgaccgattctctggctccaagtctggcacctcagcctccctggccatcagtgggctccggtccgacgatgaggctgattattactgttcagcttgggatgacagcctgaatacttgggttttcggcggagggaccaagttgaccgccctaggtcagcccaaggctcg

SEQ ID NO: 585555 - DNA, 521 bp, Homo sapiens; identical to SEQ ID NO: 539470
  misc_feature: HIJSMM301E4GY3.27.23.C01.1.454.light.4.raw

SEQ ID NO: 585556 - DNA, 501 bp, Homo sapiens
  misc_feature: HIJSMM301EH0OH.11.21.B10.1.454.light.4.raw
cgagagataccacgaccggtgctcgatttagtgtcgtcgcaaggagaggggggaggaactgctcagttaggacccagagggaaccatggaagccccagctcagcttctcttcctcctgctactctggctcccagatagcaccggagaaattgtgttgacacagtctccagccaccctgtctttgtctccaggggaaagagccaccctctcctgcagggccagtcagagtgttaacagctacttagcctggtaccaacagaaacctggccagactcccaggctcctcatctatgatgcatccaacagggccactggcaccccagccaggttcagtggcagtgggtctgggacagacttcactctcaccatcagcagcctagagcctgaggattttgcagtttattactgtcagcagcgtatcgactggatcaccttcggccaagggacacgactggaaattaaacgaactagtggctgcaccatctgtcttcatcttccccg

SEQ ID NO: 585557 - DNA, 490 bp, Homo sapiens
  misc_feature: HIJSMM301DOURN.48.78.H01.1.454.light.4.raw
agtatacatacacgaccggtgctcgatttagtgtgagtagtttgggtttggggaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaactgtggctgcacca

SEQ ID NO: 585558 - DNA, 485 bp, Homo sapiens; identical to SEQ ID NO: 536040
  misc_feature: HIJSMM301DVA29.15.1.A01.1.454.light.4.raw

SEQ ID NO: 585559 - DNA, 505 bp, Homo sapiens; identical to SEQ ID NO: 536233
  misc_feature: HIJSMM301DMGR2.48.25.C03.1.454.light.4.raw

SEQ ID NO: 585560 - DNA, 496 bp, Homo sapiens; identical to SEQ ID NO: 558251
  misc_feature: HIJSMM301BQ1SI.16.78.H01.1.454.light.4.raw

SEQ ID NO: 585561 - DNA, 476 bp, Homo sapiens; identical to SEQ ID NO: 538026
  misc_feature: HIJSMM301BP9IB.13.76.G10.1.454.light.4.raw

SEQ ID NO: 585562 - DNA, 487 bp, Homo sapiens
  misc_feature: HIJSMM301EEKJI.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggcctacgggaccgacggtcggagtgtctaagcgaactgtgcgtgcaccat

SEQ ID NO: 585563 - DNA, 501 bp, Homo sapiens
  misc_feature: HIJSMM301B26KE.49.12.B01.1.454.light.4.raw
agtcgagagacacgaccggtgctcgatttagtagtgtagattccgcgggcacgaccggtgctcgatttagtgacatctcgcagttctttgggggctctggggagtctgcaccatggcttggaccccactcctcttcctcaccctcctcctccactgcacagggtctctctcccagcttgtagggactctatcgccctctgcctctgccccccgggagcctcggtcaggctcacctgcactctgaaaggtggccacagcagatgcgccatcgcatggcatcacctgcagccagaaaagggccctcggtagttgatgaggcttaacactgatggcagccacaacaagggggacgggatccctgatcgcttctaaggctccagttctggggctgagcgctacctcaccatctccagcctccagtctgtggatgaggctgactattcctgtcagacctggggcagtgggtgttcggcggagggaccaaggtgaccgtcctagggt

SEQ ID NO: 585564 - DNA, 499 bp, Homo sapiens
  misc_feature: HIJSMM301EG4HO.51.87.H10.1.454.light.4.raw
cgatcgtatacacgaccggtgctcgatttagcagtactgcgttgggtttgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcagcatcacttgccgggccactgagaatattcataattggttggcctggtatcagcagaaaccagggaaagcccctaaactcctgatatataagacgtctaatttagaaggtgggtcccatcaaggttcagcggcggtggctctgggacagaattcactctcaccatcaccagcctgcagcctgatgattttgcaacttattactgccaacagtattaatagttattggacgttcggccaagggaccaaggtggaaatcaaacgaactgtggctgcaccatctgtcttcatcttccccg

SEQ ID NO: 585565 - DNA, 494 bp, Homo sapiens
  misc_feature: HIJSMM301AJR4Y.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcgaccaagggacacgactggagattaaaggaactgtggctgcaccatctgtcttcatcttccccg

SEQ ID NO: 585566 - DNA, 493 bp, Homo sapiens; identical to SEQ ID NO: 537422
  misc_feature: HIJSMM301A01IA.9.34.D01.1.454.light.4.raw

SEQ ID NO: 585567 - DNA, 494 bp, Homo sapiens
  misc_feature: HIJSMM301D3MDJ.51.5.A05.1.454.light.4.raw
cgatcgtatacacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgaccgtcctgagtcagcccaaggctgcccctcggtcact

SEQ ID NO: 585568 - DNA, 481 bp, Homo sapiens
  misc_feature: HIJSMM301A4B5S.12.49.E05.1.454.light.4.raw
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacaggagttcactctcaccatcagcagcctgcagcctagaagattgttgctaacttattactgtacaaaagtataacagtcgtcccccttcaccttcggccaagggacacgactggagattagaacg

SEQ ID NO: 585569 - DNA, 496 bp, Homo sapiens; identical to SEQ ID NO: 574372
  misc_feature: HIJSMM301EF2X9.21.27.C05.1.454.light.4.raw

SEQ ID NO: 585570 - DNA, 514 bp, Homo sapiens; identical to SEQ ID NO: 545978
  misc_feature: HIJSMM301APS5O.17.33.C11.1.454.light.4.raw

SEQ ID NO: 585571 - DNA, 447 bp, Homo sapiens
  misc_feature: HIJSMM301ANUOD.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgccctccctggtcatatctggtctccagggtgaggatgaggctgatttattactgccactcctatgacaacagcctgagtatttggctgttcggcggcggaccaagttgaccgtcctacgtcagcccaaggctcgccccctcggtcactctcgttcccgccctcctcgacacgcgag

SEQ ID NO: 585572 - DNA, 495 bp, Homo sapiens; identical to SEQ ID NO: 538269
  misc_feature: HIJSMM301BVCDD.9.1.A01.1.454.light.4.raw

SEQ ID NO: 585573 - DNA, 494 bp, Homo sapiens
  misc_feature: HIJSMM301BPA89.11.10.A10.1.454.light.4.raw
cgagagataccacgaccggtgctcgatttagcgtcgatctcaggggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagccaggttcagtggcagtgggtctgagacagagttcactctcaccatcaacggcctgcagtctgaagattttgcagtttattactgtcagcagtataataactggcctcggacgttcggccaagggaccaaggtggaagtcaacgaactgtggctgcaccatctgtcttcatcttcccgt

SEQ ID NO: 585574 - DNA, 490 bp, Homo sapiens
  misc_feature: HIJSMM301BKO6T.14.28.C06.1.454.light.4.raw
cgtctagtaccacgaccggtgctcgatttagagctcacgtattgggtttgggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactgtggctgcaccatctgtcttca

SEQ ID NO: 585575 - DNA, 503 bp, Homo sapiens; identical to SEQ ID NO: 557698
  misc_feature: HIJSMM301ALDV8.4.39.D06.1.454.light.4.raw

SEQ ID NO: 585576 - DNA, 521 bp, Homo sapiens
  misc_feature: HIJSMM301A3W3M.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccaacgggaccgaacggtaggaaggtacgtaaacgaacgtagtggcgtgcaccatctgtcttctactacttcccgtccact

SEQ ID NO: 585577 - DNA, 507 bp, Homo sapiens
  misc_feature: HIJSMM301BGDG4.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggcctgtccccccg

SEQ ID NO: 585578 - DNA, 502 bp, Homo sapiens
  misc_feature: HIJSMM301AUNO7.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacactatttaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatcttcccgcat

SEQ ID NO: 585579 - DNA, 488 bp, Homo sapiens; identical to SEQ ID NO: 576808
  misc_feature: HIJSMM301BFVZP.13.87.H10.1.454.light.4.raw

SEQ ID NO: 585580 - DNA, 496 bp, Homo sapiens; identical to SEQ ID NO: 561412
  misc_feature: HIJSMM301CKOUE.48.63.F08.1.454.light.4.raw

SEQ ID NO: 585581 - DNA, 491 bp, Homo sapiens
  misc_feature: HIJSMM301CKKZ9.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcacttctcgtattcggcggtgggaccaagctgaccgtcctaggtcagccc

SEQ ID NO: 585582 - DNA, 494 bp, Homo sapiens; identical to SEQ ID NO: 534994
  misc_feature: HIJSMM301AO0RL.27.78.H01.1.454.light.4.raw

SEQ ID NO: 585583 - DNA, 416 bp, Homo sapiens; identical to SEQ ID NO: 536892
  misc_feature: HIJSMM301C4C9C.16.46.E02.1.454.light.4.raw

SEQ ID NO: 585584 - DNA, 519 bp, Homo sapiens
  misc_feature: HIJSMM301E4G5S.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggcccgtcgggaccgaaacgtaggagtatacaaacgaaactagtggctgcaccaactctgtcttcta

SEQ ID NO: 585585 - DNA, 480 bp, Homo sapiens
  misc_feature: HIJSMM301D9N23.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaaccttgccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 585586 - DNA, 494 bp, Homo sapiens
  misc_feature: HIJSMM301ALS0R.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccagggaccagggtggaaatcaaacgaactagtggctgcaccatctgtcttcat

SEQ ID NO: 585587 - DNA, 490 bp, Homo sapiens; identical to SEQ ID NO: 579622
  misc_feature: HIJSMM301BE8O5.16.68.G02.1.454.light.4.raw

SEQ ID NO: 585588 - DNA, 497 bp, Homo sapiens; identical to SEQ ID NO: 554406
  misc_feature: HIJSMM301BDIIC.3.33.C11.1.454.light.4.raw

SEQ ID NO: 585589 - DNA, 507 bp, Homo sapiens; identical to SEQ ID NO: 536874
  misc_feature: HIJSMM301AYRGR.17.41.D08.1.454.light.4.raw

SEQ ID NO: 585590 - DNA, 495 bp, Homo sapiens
  misc_feature: HIJSMM301B1POK.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctcttcggaactgggaccacggtcaccgtcctaggtcagcccaaggccaacccca

SEQ ID NO: 585591 - DNA, 454 bp, Homo sapiens; identical to SEQ ID NO: 536846
  misc_feature: HIJSMM301EX3QS.18.78.H01.1.454.light.4.raw

SEQ ID NO: 585592 - DNA, 489 bp, Homo sapiens; identical to SEQ ID NO: 539323
  misc_feature: HIJSMM301EQCRG.49.46.E02.1.454.light.4.raw

SEQ ID NO: 585593 - DNA, 517 bp, Homo sapiens; identical to SEQ ID NO: 538903
  misc_feature: HIJSMM301D5FD3.41.25.C03.1.454.light.4.raw

SEQ ID NO: 585594 - DNA, 468 bp, Homo sapiens
  misc_feature: HIJSMM301ARERL.5.36.D03.1.454.light.4.raw
atcagacacgcacgaccggtgctcgatttagctgcgtcacgatctctcttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatacaaacgaa

SEQ ID NO: 585595 - DNA, 488 bp, Homo sapiens
  misc_feature: HIJSMM301BAMBX.11.28.C06.1.454.light.4.raw
cgagagataccacgaccggtgctcgatttagagctcacgtattgggtttggggctgatcaggactcctcagttcaccttctcacaatgaggctccctgctcagctcctggggctgctaatgctctgggtcccagtgtccagtggggatgttgtgttgactcagtctccactctccctgcccgtcacccttggacagccggcctccatctcctgcaggtcaagtcagagcctcgttcacgataatgggaacacctacttgagttggtttcagcagaggccaggccaatctccaaggcgcctaatttataaggtttctaggcgggactctggggtcccagacagattcagcggcagtgggtcaggcgctgatttcacactgagaatcagcagggtggaggctgaagatgtcggggtttattactgcatgcaggtacagtgtggccttcgctcgcattcggcggagggaccgaaggtggagatcaaacgaa

SEQ ID NO: 585596 - DNA, 480 bp, Homo sapiens
  misc_feature: HIJSMM301CGUP8.48.55.E11.1.454.light.4.raw
agtatacatacacgaccggtgctcgatttagcactcgcacgttgggtttggggggagaagagctgctcagttaggacccagagggaaccatggaaaccccagcgcagcttctcttcctcctgctactctggctcccagataccaccggagcacttgtgttgacgcagtctccaggcaccctgtctttgtctccaggggagagagccaccctctcctgcagggccagtcagagtgttagcggcggctccgtagcctggtaccagcagaaacgtggccaggttcccaggctcctcatctatgatgcatccagcagggccactggcatcccagacaggttcagtggcagtgggtctgggacagacttcactctcaccatcagcagactggagcctgaagattttgcagtgtattactgtcagcagtatggtagctcacctcaactcactttcggcggagggaccaaggtggagatcaaacgaa

SEQ ID NO: 585597 - DNA, 478 bp, Homo sapiens; identical to SEQ ID NO: 535129
  misc_feature: HIJSMM301BRJVA.11.11.A11.1.454.light.4.raw

SEQ ID NO: 585598 - DNA, 495 bp, Homo sapiens
  misc_feature: HIJSMM301AUGKB.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttggggtttattactgcatgcaaggtttataccttcctcggactttcggtcccgtcggaccgacgagtggagtgtcaaacgaaactacgt

SEQ ID NO: 585599 - DNA, 482 bp, Homo sapiens; identical to SEQ ID NO: 544520
  misc_feature: HIJSMM301C1MXQ.49.28.C06.1.454.light.4.raw

SEQ ID NO: 585600 - DNA, 518 bp, Homo sapiens; identical to SEQ ID NO: 539372
  misc_feature: HIJSMM301AKNSE.7.86.H09.1.454.light.4.raw

SEQ ID NO: 585601 - DNA, 520 bp, Homo sapiens; identical to SEQ ID NO: 563649
  misc_feature: HIJSMM301DFUND.27.23.C01.1.454.light.4.raw

SEQ ID NO: 585602 - DNA, 496 bp, Homo sapiens
  misc_feature: HIJSMM301CAZRR.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttatactgtcagcaatattatattcctctcagacgttcggccaagggaccaaggtggaaatcaaacgaactgtggctgcacc

SEQ ID NO: 585603 - DNA, 484 bp, Homo sapiens
  misc_feature: HIJSMM301C4WBO.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgataccctccgctcactttcggcggagggaccaaggtggagatcaaacgaactgtggctgcacc

SEQ ID NO: 585604 - DNA, 495 bp, Homo sapiens
  misc_feature: HIJSMM301BX93H.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggtcaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 585605 - DNA, 501 bp, Homo sapiens
  misc_feature: HIJSMM301DLR0S.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctccccggaccgtcgtccaggacgaacggaggaagtacaagacgaaccagtaggcgtgtcgaccaactctcgtcttct

SEQ ID NO: 585606 - DNA, 475 bp, Homo sapiens
  misc_feature: HIJSMM301A0VRT.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgctcctccgagtgccacttttggtcggggggaccgaaggtggacatcaaacgaaa

SEQ ID NO: 585607 - DNA, 493 bp, Homo sapiens
  misc_feature: HIJSMM301A8XQ3.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgaactggagattaaggaactgtggctgcaccatctgtcttcatcttcccg

SEQ ID NO: 585608 - DNA, 498 bp, Homo sapiens
  misc_feature: HIJSMM301EU7HI.43.35.D02.1.454.light.4.raw
tgtgagtagtcacgaccggtgctcgatttagcacacgatagttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacacggtcaccgtcctaggtcagcccaaggccaacccca

SEQ ID NO: 585609 - DNA, 513 bp, Homo sapiens
  misc_feature: HIJSMM301ALDJL.8.42.D09.1.454.light.4.raw
ctcgcgtgtccacgaccggtgctcgatttagacacatacgcagggaaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttcgaccgtcctaggtcagcccaaggctgccccctcggtcacctctgttcccgccctccc

SEQ ID NO: 585610 - DNA, 484 bp, Homo sapiens; identical to SEQ ID NO: 535400
  misc_feature: HIJSMM301D0N8Q.46.26.C04.1.454.light.4.raw

SEQ ID NO: 585611 - DNA, 499 bp, Homo sapiens
  misc_feature: HIJSMM301C1T34.10.37.D04.1.454.light.4.raw
catagtagtgcacgaccggtgctcgatttagtagcatactgttgggtttgggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtccaagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaactgtggctgcaccatctgtcttcta

SEQ ID NO: 585612 - DNA, 517 bp, Homo sapiens
  misc_feature: HIJSMM301BR7BF.10.75.G09.1.454.light.4.raw
catagtagtgcacgaccggtgctcgatttagtatagacatcaggggggggtctcaggaggcagcgctctcgggacgtctccaccatggcctgggctctgctattcctcaccctcctcactcagggcacaggttcctgggcccagtctgccctgtctcagcctgcctccgtgtctgggtctcctggacagtcgatcaccatctcctgcaatggaagcgaaagtgacattggttctttaaattttgtctcttggtaccaacagagcccagacaaagcccccaaaattatcatttctgctgtcagtaatcggccctcaggggtttctagtcgcttctctggctccaagtctggcaacacggcccccctgaccatctctgggctccaggctgaggacgaggctgattattattgcagctcatatacaaacaccaaagctttgatattcggcggagggaccaaactgaccgtccttcgtcagcccaacggctgccccctcggtccactctgttcccaccctt

SEQ ID NO: 585613 - DNA, 481 bp, Homo sapiens; identical to SEQ ID NO: 571707
  misc_feature: HIJSMM301B850V.13.8.A08.1.454.light.4.raw

SEQ ID NO: 585614 - DNA, 486 bp, Homo sapiens; identical to SEQ ID NO: 554850
  misc_feature: HIJSMM301EUDDI.41.72.G06.1.454.light.4.raw

SEQ ID NO: 585615 - DNA, 503 bp, Homo sapiens
  misc_feature: HIJSMM301CTJ4R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagtggctgcaccatctgtcttcatcttcccg

SEQ ID NO: 585616 - DNA, 486 bp, Homo sapiens
  misc_feature: HIJSMM301C55HB.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctcgttcccgccctcctcgctacgtaga

SEQ ID NO: 585617 - DNA, 497 bp, Homo sapiens; identical to SEQ ID NO: 541336
  misc_feature: HIJSMM301DIWTP.26.72.G06.1.454.light.4.raw

SEQ ID NO: 585618 - DNA, 492 bp, Homo sapiens
  misc_feature: HIJSMM301AG2TX.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagttttattactgtcagcaatattatagtactcctccgaggctcactttcggcggagggaccaaggtggagatcaaacgaa

SEQ ID NO: 585619 - DNA, 504 bp, Homo sapiens; identical to SEQ ID NO: 535495
  misc_feature: HIJSMM301DEJKU.14.86.H09.1.454.light.4.raw

SEQ ID NO: 585620 - DNA, 481 bp, Homo sapiens
  misc_feature: HIJSMM301A000U.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtca

SEQ ID NO: 585621 - DNA, 504 bp, Homo sapiens; identical to SEQ ID NO: 549053
  misc_feature: HIJSMM301A9M4E.4.71.G05.1.454.light.4.raw

SEQ ID NO: 585622 - DNA, 493 bp, Homo sapiens; identical to SEQ ID NO: 580714
  misc_feature: HIJSMM301BDCHZ.40.11.A11.1.454.light.4.raw

SEQ ID NO: 585623 - DNA, 485 bp, Homo sapiens
  misc_feature: HIJSMM301DU97C.4.34.D01.1.454.light.4.raw
agcactgtagcacgaccggtgctcgatttagatcgtctgtgttgggtttgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccagaccaatatgcttactggtaccagcagaagccaggccaggcccctgtgttgttgttatataaagacagtgagaggccctcagggatccctgagcgattctctggctccagctcagggacaacagtcacgttgaccatcagtggagtccaggcagaagacgaggctgactattactgtcaatcagcagacagcggtgggacttataaagagttcggcggagggaccaagctgaccgtcctaggtcagcccaaggctg

SEQ ID NO: 585624 - DNA, 451 bp, Homo sapiens
  misc_feature: HIJSMM301ADR1L.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaaacccctctgtcactctcgttccctaccctcctccactactcgta

SEQ ID NO: 585625 - DNA, 487 bp, Homo sapiens
  misc_feature: HIJSMM301A9O30.26.70.G04.1.454.light.4.raw
agactatactcacgaccggtgctcgatttagtgtagtgtgaagggaaagggggcaggaatcagacccagtcaggacacagcatggacatgagagtcctcgctcagctcctggggctcctgctgctctgtttcccaggtgccagatgtgacatccagatgacccagtcgccatcctcactgtctgcctctgtaggagacagagtcaccatcacttgtcgggcgagtcagggcattagcgattttttagcctggtttcagcagaaaccagggaaagcccccaagtccctgatctatgctgcgtccactttagaaggtggagtcccatcaaggttcagcggcagtggatctgggacagagttcactctcaacatcagcagcctgcagcctgaggattttgcaacttattactgccagcagtataatgattaccctatcaccttcggccggggacacggctaggaaactaaacgaactgtggctgcaccta

SEQ ID NO: 585626 - DNA, 472 bp, Homo sapiens; identical to SEQ ID NO: 556898
  misc_feature: HIJSMM301DD25R.13.76.G10.1.454.light.4.raw

SEQ ID NO: 585627 - DNA, 508 bp, Homo sapiens
  misc_feature: HIJSMM301DON2Z.53.71.G05.1.454.light.4.raw
cgcgtatacacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctcg

SEQ ID NO: 585628 - DNA, 474 bp, Homo sapiens
  misc_feature: HIJSMM301EMPZQ.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtgggtcccatcaaggttcagtggcagtggatctgggactagatttcactctcaccatcaacagtctgcaacctgaagattttgcaacttactactgtcaacagagtttcactacccctctcactttcggcggggggaccgaaggtggagatcaaacgaa

SEQ ID NO: 585629 - DNA, 489 bp, Homo sapiens; identical to SEQ ID NO: 535139
  misc_feature: HIJSMM301DRUCV.14.55.E11.1.454.light.4.raw

SEQ ID NO: 585630 - DNA, 444 bp, Homo sapiens; identical to SEQ ID NO: 535192
  misc_feature: HIJSMM301D5WQF.5.9.A09.1.454.light.4.raw

SEQ ID NO: 585631 - DNA, 455 bp, Homo sapiens; identical to SEQ ID NO: 559855
  misc_feature: HIJSMM301EWD0S.19.86.H09.1.454.light.4.raw

SEQ ID NO: 585632 - DNA, 493 bp, Homo sapiens
  misc_feature: HIJSMM301DJM9V.49.67.G01.1.454.light.4.raw
agtcgagagacacgaccggtgctcgatttagagtatacatattgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccagtttcagtggcagtgggtctgggacagacttcactctcaccatcagcagcctagagcctgaagattttgcagtctattactgtcagcagcgttacaactggcctcccatgtactacttttggccaggggaccaagctaggaatcagacgaactgtggctgcaccat

SEQ ID NO: 585633 - DNA, 472 bp, Homo sapiens
  misc_feature: HIJSMM301ELR4E.52.49.E05.1.454.light.4.raw
cgcagtacgacacgaccggtgctcgatttagagcgactagcaacacacaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacgaagtcaccatgacttgccgggcaagtcagagcattagcagccatttgaattggtatcagcagaaacctgggaaagcccctcagctcctgatctttgctgcatccagtttgcacagtggggtcccatcaaggttcagtggcagtggatctgggacagacttcactctcaccatcagcagtctgcaacctgaggattttgccacttactactgtcaacagacttacaatacccctccatacacttttgccaggggaccaagctggagatcagaacg

SEQ ID NO: 585634 - DNA, 491 bp, Homo sapiens
  misc_feature: HIJSMM301EUU9O.16.68.G02.1.454.light.4.raw
tgtactactccacgaccggtgctcgatttagtcgatagtgaagggaaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggtggagggaccaaggtggaggtcaaacgaactagtggctgcacatctgtcttcatt

SEQ ID NO: 585635 - DNA, 486 bp, Homo sapiens; identical to SEQ ID NO: 535043
  misc_feature: HIJSMM301CVDB4.46.35.D02.1.454.light.4.raw

SEQ ID NO: 585636 - DNA, 490 bp, Homo sapiens
  misc_feature: HIJSMM301BGN41.52.35.D02.1.454.light.4.raw
cgcagtacgacacgaccggtgctcgatttagcacacgatagttgggtttgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcact

SEQ ID NO: 585637 - DNA, 494 bp, Homo sapiens; identical to SEQ ID NO: 534994
  misc_feature: HIJSMM301D6TVY.27.78.H01.1.454.light.4.raw

SEQ ID NO: 585638 - DNA, 492 bp, Homo sapiens; identical to SEQ ID NO: 537395
  misc_feature: HIJSMM301B2CXG.16.73.G07.1.454.light.4.raw

SEQ ID NO: 585639 - DNA, 497 bp, Homo sapiens
  misc_feature: HIJSMM301CPSXH.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcaccatctgtcttcattcc

SEQ ID NO: 585640 - DNA, 500 bp, Homo sapiens
  misc_feature: HIJSMM301BIFIZ.43.34.D01.1.454.light.4.raw
tgtgagtagtcacgaccggtgctcgatttagatcgtctgtgttgggtttgggggctttgcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccactgtcactctcgttcccacctcctcactactcactac

SEQ ID NO: 585641 - DNA, 520 bp, Homo sapiens
  misc_feature: HIJSMM301DIQSO.4.21.B10.1.454.light.4.raw
agcactgtagcacgaccggtgctcgatttagtgtcgtcgcaagagagagagaggaggggggggctcaggaggcagagctctgggaatctcaccatggcctggacccctctcctgcctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagaacgacaaaacgaccctccgggatccctgagagattctctggctccagctcagggactatggccaccttgactatcagtggggcccaagtggaggatgaagctgactactactgttactcaatagagaaacagtgataaattttctgggttggttcgggcggaagggaccaaaacgtgaaccgtcctaggtcagcccaagctcgccccctcggtcacttc

SEQ ID NO: 585642 - DNA, 483 bp, Homo sapiens
  misc_feature: HIJSMM301B70U1.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatctgcagagtggaggctgaggatgttggggttattactgcatgcaagctctacaacctctgcggactttcggccctgg

SEQ ID NO: 585643 - DNA, 483 bp, Homo sapiens
  misc_feature: HIJSMM301AY0VV.40.59.F04.1.454.light.4.raw
tctagcgactcacgaccggtgctcgatttagtacacacacttagggattgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacgatcagcagtgaggtggttttcggcggagggaccgaagctgaccgtcctaagtcagcccaaggcg

SEQ ID NO: 585644 - DNA, 467 bp, Homo sapiens
  misc_feature: HIJSMM301C41NK.49.79.H02.1.454.light.4.raw
agtcgagagacacgaccggtgctcgatttagtgtcacacgaagggaaagggggagtcagtcccaaccaggacacagcatggacatgagggtccctgctcagctcctggggctcctgctgctctggctctcaggtgccagatgtgtcatccagatgacccagtctccttcctccctgtctgcatctataggagacagaatcaccatcacttgccgggcgagtcgagacattagcatgtatctgaattggtatcagcaaaaaccagggacagcccctaaactcctgatcctcgatgcatccactttggagacaggggtcccatcaaggttcagtggaagtggctctgggacagattttactttcaccatcagcaggctgcagcctgaagatattgcaacatattactgtcaacagtatgatcgtctcccgctcactttcggcgggggaccaaggtggagatcaagcgaa

SEQ ID NO: 585645 - DNA, 496 bp, Homo sapiens; identical to SEQ ID NO: 535541
  misc_feature: HIJSMM301CYHHY.3.33.C11.1.454.light.4.raw

SEQ ID NO: 585646 - DNA, 487 bp, Homo sapiens
  misc_feature: HIJSMM301AT7LF.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaaactgaccgtcctaggtcagcccaaggctgccccctcggtcactctgttcccgccctcctctaccgtgagct

SEQ ID NO: 585647 - DNA, 495 bp, Homo sapiens; identical to SEQ ID NO: 538269
  misc_feature: HIJSMM301AQEOA.9.1.A01.1.454.light.4.raw

SEQ ID NO: 585648 - DNA, 502 bp, Homo sapiens; identical to SEQ ID NO: 543172
  misc_feature: HIJSMM301ETXQ6.18.59.F04.1.454.light.4.raw

SEQ ID NO: 585649 - DNA, 506 bp, Homo sapiens; identical to SEQ ID NO: 535058
  misc_feature: HIJSMM301A1C5L.17.41.D08.1.454.light.4.raw

SEQ ID NO: 585650 - DNA, 494 bp, Homo sapiens; identical to SEQ ID NO: 536463
  misc_feature: HIJSMM301DH67I.22.57.F02.1.454.light.4.raw

SEQ ID NO: 585651 - DNA, 510 bp, Homo sapiens
  misc_feature: HIJSMM301ADUF6.16.1.A01.1.454.light.4.raw
tgtactactccacgaccggtgctcgatttagacgtctcatcaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 585652 - DNA, 485 bp, Homo sapiens; identical to SEQ ID NO: 536630
  misc_feature: HIJSMM301A0LBB.13.56.F01.1.454.light.4.raw

SEQ ID NO: 585653 - DNA, 486 bp, Homo sapiens
  misc_feature: HIJSMM301DRHVP.49.76.G10.1.454.light.4.raw
agtcgagagacacgaccggtgctcgatttagtcactcatacagggggagtcagtctcagtcaggacacagcatggacatgagggtccccgctcagctcctggggctcctgctactctggctccgaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgttattttactttcaccatcatcaacctgcagcctgaggatattgcaacatattactgtcaacaatatgataaatctaccactcactttcggcggagggaccacggtggagatcaaacgaactgtggctgcaccatctgtctt

SEQ ID NO: 585654 - DNA, 480 bp, Homo sapiens
  misc_feature: HIJSMM301EGYHK.52.33.C11.1.454.light.4.raw
cgcagtacgacacgaccggtgctcgatttagagtgagctcgttggctgtgggtccaggaggcagaactctgggtgtctcaccatggcctggatccctctacttctccccctcctcactctctgcacaggctctgaggcctcctatgagctgacacagccaccctcggtgtctgtgtcctcaggacagacggccaggatcacctgctctggagatgcattgccaaagcaatatgcttactggtaccagcagaagcccggccaggcccctgtcttgcttatttataaagactttgagaggccctcagggacccctgagcgattctctggctccagctcagcgacaacagtcacgttgaccatcagtggagtccaggcagaggacgaggctgactattactgtcagtcatcagacagcagtggcacttatgtcgtattcggcggaggaccaaactgaccgtcctaggtcagcccaaggctccg

SEQ ID NO: 585655 - DNA, 498 bp, Homo sapiens
  misc_feature: HIJSMM301AVZEI.52.34.D01.1.454.light.4.raw
cgcagtacgacacgaccggtgctcgatttagatcgtctgtgttgggtttgggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattagcaactacttagcctggtaccaacagaaacctggccaggctcccaggctcctcatctatgatgcgtccaacagggccactggcatcccagccaggttcagtggcggtgggtctgggacagacttcactctcaccatcagcagcctagagcctgaagattttgcagtttattactgtcagcagcgtagcaactggcctccgatcaccttcggccaagggacacgactggagattaaacgaactgtggctgcaccatctgtctcat

SEQ ID NO: 585656 - DNA, 480 bp, Homo sapiens; identical to SEQ ID NO: 535630
  misc_feature: HIJSMM301A415T.40.59.F04.1.454.light.4.raw

SEQ ID NO: 585657 - DNA, 517 bp, Homo sapiens
  misc_feature: HIJSMM301DEFKQ.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctcacg

SEQ ID NO: 585658 - DNA, 488 bp, Homo sapiens
  misc_feature: HIJSMM301DOC87.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaaggaccaagctggagatcaacgaactgtggctgcaccta

SEQ ID NO: 585659 - DNA, 493 bp, Homo sapiens
  misc_feature: HIJSMM301C5V7T.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggacgggacgaacggtaggagatcaaacgaactac

SEQ ID NO: 585660 - DNA, 523 bp, Homo sapiens; identical to SEQ ID NO: 575525
  misc_feature: HIJSMM301B9TD0.27.23.C01.1.454.light.4.raw

SEQ ID NO: 585661 - DNA, 496 bp, Homo sapiens; identical to SEQ ID NO: 535541
  misc_feature: HIJSMM301AODAQ.3.33.C11.1.454.light.4.raw

SEQ ID NO: 585662 - DNA, 501 bp, Homo sapiens
  misc_feature: HIJSMM301CXSTH.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagcgggtctgggacagatttcactctcaccatcagcagccttcaggctgaagatgtggcagtttatactgtcagcaatattatatctctcctcctcggacgttcggccaagggaccgagggtggaaagtacaaacgaactgtggctgcaccatctgtcttcatcttcccgccat

SEQ ID NO: 585663 - DNA, 514 bp, Homo sapiens
  misc_feature: HIJSMM301CTF1G.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacagtcagtggggcccaggtggaggatgagggtgattactactgttactcaacagacattactactactcatagggtgttcgggcggagggaccaagctgaccgtcctaggtcagcccaaggctgccccctcggtcactctcgttcccgccct

SEQ ID NO: 585664 - DNA, 511 bp, Homo sapiens
  misc_feature: HIJSMM301B38HH.14.85.H08.1.454.light.4.raw
cgtctagtaccacgaccggtgctcgatttagtatcactcagtcgcgggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcactcttcg

SEQ ID NO: 585665 - DNA, 507 bp, Homo sapiens; identical to SEQ ID NO: 563469
  misc_feature: HIJSMM301ECB38.47.85.H08.1.454.light.4.raw

SEQ ID NO: 585666 - DNA, 496 bp, Homo sapiens; identical to SEQ ID NO: 537925
  misc_feature: HIJSMM301ANLW4.22.14.B03.1.454.light.4.raw

SEQ ID NO: 585667 - DNA, 486 bp, Homo sapiens; identical to SEQ ID NO: 537144
  misc_feature: HIJSMM301ECEFL.46.35.D02.1.454.light.4.raw

SEQ ID NO: 585668 - DNA, 521 bp, Homo sapiens; identical to SEQ ID NO: 539470
  misc_feature: HIJSMM301EAGQH.27.23.C01.1.454.light.4.raw

SEQ ID NO: 585669 - DNA, 501 bp, Homo sapiens; identical to SEQ ID NO: 548482
  misc_feature: HIJSMM301A3ZYW.41.71.G05.1.454.light.4.raw

SEQ ID NO: 585670 - DNA, 510 bp, Homo sapiens
  misc_feature: HIJSMM301CZ8NF.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagccctgaagattttgctagtttattactgtcaacagcgtagcagcaggcctccggcgacgttcggccaagggaccaaggtggaagtcaagcgaactgtggctgcaccatctgtcttcatcttcccgcc

SEQ ID NO: 585671 - DNA, 513 bp, Homo sapiens
  misc_feature: HIJSMM301DDU4M.40.47.E03.1.454.light.4.raw
tctagcgactcacgaccggtgctcgatttagactcgcgcacagagagaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctcctgaccgtctctgggctccaggctgaggatgaggctgtttactactgcagctcatatgcaggcagcaataatttggtggttcggcgggggaccgaagctgaccgtcctaggtcagcccaaggctgccccctcggtcactctcg

SEQ ID NO: 585672 - DNA, 519 bp, Homo sapiens
  misc_feature: HIJSMM301BD9YI.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctcgttcccaccctcctcacg

SEQ ID NO: 585673 - DNA, 503 bp, Homo sapiens; identical to SEQ ID NO: 566553
  misc_feature: HIJSMM301DPR67.4.39.D06.1.454.light.4.raw

SEQ ID NO: 585674 - DNA, 496 bp, Homo sapiens; identical to SEQ ID NO: 535109
  misc_feature: HIJSMM301AZ56C.16.78.H01.1.454.light.4.raw

SEQ ID NO: 585675 - DNA, 487 bp, Homo sapiens; identical to SEQ ID NO: 536206
  misc_feature: HIJSMM301A6KU1.47.38.D05.1.454.light.4.raw

SEQ ID NO: 585676 - DNA, 522 bp, Homo sapiens; identical to SEQ ID NO: 561516
  misc_feature: HIJSMM301CS7IX.27.23.C01.1.454.light.4.raw

SEQ ID NO: 585677 - DNA, 504 bp, Homo sapiens
  misc_feature: HIJSMM301AUB6D.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaacgggaccgaacggtaggaaagtacaaacgaactacgtggcgtgc

SEQ ID NO: 585678 - DNA, 490 bp, Homo sapiens
  misc_feature: HIJSMM301BWP9G.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacagtacccccctcactttcggcggagggaccaaggcggagatcagacgaactgtggctgcaccatctgtcttcta

SEQ ID NO: 585679 - DNA, 485 bp, Homo sapiens; identical to SEQ ID NO: 535609
  misc_feature: HIJSMM301EU93A.46.35.D02.1.454.light.4.raw

SEQ ID NO: 585680 - DNA, 491 bp, Homo sapiens
  misc_feature: HIJSMM301D7NZ2.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccgagggtggagatcaaacgaactgtggctgcaccatctgtcttc

SEQ ID NO: 585681 - DNA, 505 bp, Homo sapiens
  misc_feature: HIJSMM301D0RNG.48.34.D01.1.454.light.4.raw
agtatacatacacgaccggtgctcgatttagatcgtctgtgttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggttttattactgtcagcagcgtgccaactggcctctcacgttcggcggagggaccaaggtggacatcaaacgaactgtggctgcaccatctgtcttcatcttccccg

SEQ ID NO: 585682 - DNA, 495 bp, Homo sapiens; identical to SEQ ID NO: 535596
  misc_feature: HIJSMM301C5WN3.10.79.H02.1.454.light.4.raw

SEQ ID NO: 585683 - DNA, 489 bp, Homo sapiens; identical to SEQ ID NO: 543840
  misc_feature: HIJSMM301DXHV2.12.88.H11.1.454.light.4.raw

SEQ ID NO: 585684 - DNA, 521 bp, Homo sapiens; identical to SEQ ID NO: 549643
  misc_feature: HIJSMM301DAUED.10.86.H09.1.454.light.4.raw

SEQ ID NO: 585685 - DNA, 486 bp, Homo sapiens; identical to SEQ ID NO: 535290
  misc_feature: HIJSMM301ECX57.3.12.B01.1.454.light.4.raw

SEQ ID NO: 585686 - DNA, 485 bp, Homo sapiens; identical to SEQ ID NO: 538194
  misc_feature: HIJSMM301BKHEG.47.62.F07.1.454.light.4.raw

SEQ ID NO: 585687 - DNA, 489 bp, Homo sapiens; identical to SEQ ID NO: 535139
  misc_feature: HIJSMM301D2IQH.14.55.E11.1.454.light.4.raw

SEQ ID NO: 585688 - DNA, 478 bp, Homo sapiens
  misc_feature: HIJSMM301BYUW5.4.10.A10.1.454.light.4.raw
agcactgtagcacgaccggtgctcgatttagcgtcgatctcaggggagtcagtcccagtcaggacacagcatggacatgagggtccccgctcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagactttcactctcaccatcagcagcctacagcctgaagattttgcaacttattactgtcaacagcttaataattacgcgctcactttcggcggagggaccaaggtggagatcaaacgaactagtggctgcaccat

SEQ ID NO: 585689 - DNA, 493 bp, Homo sapiens; identical to SEQ ID NO: 537281
  misc_feature: HIJSMM301D4A4K.9.1.A01.1.454.light.4.raw

SEQ ID NO: 585690 - DNA, 494 bp, Homo sapiens; identical to SEQ ID NO: 534992
  misc_feature: HIJSMM301B6TQX.9.1.A01.1.454.light.4.raw

SEQ ID NO: 585691 - DNA, 520 bp, Homo sapiens
  misc_feature: HIJSMM301C0MI9.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttgaaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccct

SEQ ID NO: 585692 - DNA, 493 bp, Homo sapiens; identical to SEQ ID NO: 536007
  misc_feature: HIJSMM301B9UHB.27.78.H01.1.454.light.4.raw

SEQ ID NO: 585693 - DNA, 501 bp, Homo sapiens
  misc_feature: HIJSMM301EE2DW.17.29.C07.1.454.light.4.raw
cgtagactagcacgaccggtgctcgatttagagtgctacgaagggaaaggggggggtcgtcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctgccccccg

SEQ ID NO: 585694 - DNA, 447 bp, Homo sapiens; identical to SEQ ID NO: 535201
  misc_feature: HIJSMM301BB0WR.18.9.A09.1.454.light.4.raw

SEQ ID NO: 585695 - DNA, 521 bp, Homo sapiens; identical to SEQ ID NO: 538715
  misc_feature: HIJSMM301BPW1D.27.23.C01.1.454.light.4.raw

SEQ ID NO: 585696 - DNA, 497 bp, Homo sapiens
  misc_feature: HIJSMM301DPQ3P.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggccgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 585697 - DNA, 517 bp, Homo sapiens; identical to SEQ ID NO: 539607
  misc_feature: HIJSMM301D0WDN.41.55.E11.1.454.light.4.raw

SEQ ID NO: 585698 - DNA, 493 bp, Homo sapiens
  misc_feature: HIJSMM301CTNIT.10.72.G06.1.454.light.4.raw
catagtagtgcacgaccggtgctcgatttagctacgactgcaagggaaagggggtctcaggaggcagcgctctcgggacgtctccaccatggccttgggctctgctattcctcaccctcctcactcagggcacagggtcctgggcccagtctgccctgactcagcctgactccgtgtctgggtctcctggacagtcgatcactatctcctgcactggcaccagcagtgacataggtgcttataactatgtctcctggtaccaacaacacccacggccaggcccccagactcatcatttctgatgtcagtgatcggccctttgggatttctaatcgcttctctgcctccaagtctggcaacacggcttcctgaccatctccgggctccacgctgaggacgaggctcattattactgcagctcatatacacccaggggcacgtctcgtgatattcggcggagggacctggctgaccgtcctacgtcacgcccaac

SEQ ID NO: 585699 - DNA, 501 bp, Homo sapiens; identical to SEQ ID NO: 538461
  misc_feature: HIJSMM301CL2FH.13.11.A11.1.454.light.4.raw

SEQ ID NO: 585700 - DNA, 479 bp, Homo sapiens
  misc_feature: HIJSMM301CQ59R.40.9.A09.1.454.light.4.raw
tctagcgactcacgaccggtgctcgatttagcgagacgcgcagggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaa

SEQ ID NO: 585701 - DNA, 418 bp, Homo sapiens
  misc_feature: HIJSMM301AR21X.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaattacttttgtcttcggaactgggaccaaggtcaccgtcctaggtcagcccaaggcccaaccccactgtcactctgttcccgccctcctcgagtagtaca

SEQ ID NO: 585702 - DNA, 441 bp, Homo sapiens; identical to SEQ ID NO: 534971
  misc_feature: HIJSMM301CJ1FY.11.3.A03.1.454.light.4.raw

SEQ ID NO: 585703 - DNA, 519 bp, Homo sapiens
  misc_feature: HIJSMM301CHTVC.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaaagtaaaaatggaaacatttacttacattggtttcaacagaggccaggccagtctccaaggcgcctgatttatgacgtttttaaacgggagtcgtggggtcccagacagattcagcggcagtgggtcagacactgacttcacactgagaatcagcagggttgaggctgaggatgttggcattattactgcatgcaaggctcacactggcctccgtggacgttcggccaaggaccggggtacggaaagtaaaacgaaacgtaagtggcgtgcacactctgtcttctatt

SEQ ID NO: 585704 - DNA, 485 bp, Homo sapiens
  misc_feature: HIJSMM301AU9VA.3.40.D07.1.454.light.4.raw
agacgcactccacgaccggtgctcgatttagtgatagagcgtaacaacagaggggagactcagtcaggacacagcatggacatgagggtccccgctcagctcctggggctcctgctgctctggctcccaggtgccagatgtgacatccagatgacccagtctccttccaccctgtctgcctctataggagacagagtcaccatcacttgcggggccagtcagagtataagtaatttgttggcctggtatcagcagaaaccaggcaaagccccaaagctccttatttctgatgcctccactttgcacgttggggtcccaccaacgttcagcggcagtggatctgggacagatttcactctcaccatcagcagcctgcagcctgatgatgttgcaacttattactgtcaacaatataacacttattggacgttcggccaggggaccaaggtggaaatacaaaacgaactgtggctgcaccatctgtt

SEQ ID NO: 585705 - DNA, 514 bp, Homo sapiens
  misc_feature: HIJSMM301DW087.48.37.D04.1.454.light.4.raw
agtatacatacacgaccggtgctcgatttagtagcatactgttgggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtca

SEQ ID NO: 585706 - DNA, 487 bp, Homo sapiens; identical to SEQ ID NO: 536206
  misc_feature: HIJSMM301D1BZI.47.38.D05.1.454.light.4.raw

SEQ ID NO: 585707 - DNA, 483 bp, Homo sapiens; identical to SEQ ID NO: 547051
  misc_feature: HIJSMM301B2YC2.46.26.C04.1.454.light.4.raw

SEQ ID NO: 585708 - DNA, 503 bp, Homo sapiens; identical to SEQ ID NO: 544567
  misc_feature: HIJSMM301EI1QZ.41.35.D02.1.454.light.4.raw

SEQ ID NO: 585709 - DNA, 495 bp, Homo sapiens; identical to SEQ ID NO: 536931
  misc_feature: HIJSMM301EY3DL.10.33.C11.1.454.light.4.raw

SEQ ID NO: 585710 - DNA, 486 bp, Homo sapiens
  misc_feature: HIJSMM301DTGJL.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcgggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggccagggaccaagctggagatcaatcgaa

SEQ ID NO: 585711 - DNA, 482 bp, Homo sapiens
  misc_feature: HIJSMM301DVC1J.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtcgacggacgaacggtgaaagtacaagacgacgtaatggcgtgc

SEQ ID NO: 585712 - DNA, 481 bp, Homo sapiens
  misc_feature: HIJSMM301CQBXC.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggcctcccaggctcctcatctatggtgcatctaccagggccactggtactcccagccaggttcagtggcaggtgggtctgggacagagttcactctcaccatcagcagcctgcagtctgaagtatttgctagtttattactgtcagcagtataataactggttcctgctcacgtttcgggcgggggaccgaaggtggagatacaaacgac

SEQ ID NO: 585713 - DNA, 486 bp, Homo sapiens; identical to SEQ ID NO: 535043
  misc_feature: HIJSMM301E17OL.46.35.D02.1.454.light.4.raw

SEQ ID NO: 585714 - DNA, 467 bp, Homo sapiens
  misc_feature: HIJSMM301CAY00.49.75.G09.1.454.light.4.raw
agtcgagagacacgaccggtgctcgatttagtatagacatcagggggagtcagtcccaaccaggacacagcatggacatgagggtccctgctcagctcctggggctcctgctgctctggctctcaagtgccagatgtgtcatccagatgacccagtctccatcctccctgtctgcatctataggagacagaatcaccatcacttgccgggcgagtcgagacattagcatgtatctgaattggtatcagcaaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtaatgatagtctcccgctcacctttcggcggggggaccgaaaggtggagatccagcgaa

SEQ ID NO: 585715 - DNA, 501 bp, Homo sapiens
  misc_feature: HIJSMM301AO4AS.19.71.G05.1.454.light.4.raw
  modified_base (429)..(429): a, c, t, g, unknown or other
tactctcgtgcacgaccggtgctcgatttagtgtcgtcgcaagagagaggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatnttattatacttcgtggacgttcggtccgaacggaaccgaacggtaggagtatactagacgaacgagtggcgt

SEQ ID NO: 585716 - DNA, 514 bp, Homo sapiens
  misc_feature: HIJSMM301AHMQE.48.87.H10.1.454.light.4.raw
agtatacatacacgaccggtgctcgatttagcagtactgcgttgggtttgggggctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtcttttttcacacaaccaatgagaagaactacttagcttggtaccagcagagaccaggacaacctcctaagttgctcttttactgggcgtcttcccgggagtccggggtccctgaccgattcagtgccagcggggtctgggacagacttcactctcaccatcagcggcctgcaggctgaagatgtggcagtttattactgtcagcactgttttggcggttctccgactttcggcggagggaccgaaggtaggaggtcaaacgaactagtggctgcaccatctgtcttcta

SEQ ID NO: 585717 - DNA, 454 bp, Homo sapiens; identical to SEQ ID NO: 534964
  misc_feature: HIJSMM301BZAR9.19.86.H09.1.454.light.4.raw

SEQ ID NO: 585718 - DNA, 487 bp, Homo sapiens; identical to SEQ ID NO: 541444
  misc_feature: HIJSMM301D5YWT.19.71.G05.1.454.light.4.raw

SEQ ID NO: 585719 - DNA, 479 bp, Homo sapiens; identical to SEQ ID NO: 547479
  misc_feature: HIJSMM301A9PCR.16.81.H04.1.454.light.4.raw

SEQ ID NO: 585720 - DNA, 508 bp, Homo sapiens; identical to SEQ ID NO: 581475
  misc_feature: HIJSMM301EPUAE.21.87.H10.1.454.light.4.raw

SEQ ID NO: 585721 - DNA, 497 bp, Homo sapiens; identical to SEQ ID NO: 554406
  misc_feature: HIJSMM301B9L7T.3.33.C11.1.454.light.4.raw

SEQ ID NO: 585722 - DNA, 501 bp, Homo sapiens; identical to SEQ ID NO: 538461
  misc_feature: HIJSMM301CTF8I.13.11.A11.1.454.light.4.raw

SEQ ID NO: 585723 - DNA, 489 bp, Homo sapiens; identical to SEQ ID NO: 535139
  misc_feature: HIJSMM301C6P9H.14.55.E11.1.454.light.4.raw

SEQ ID NO: 585724 - DNA, 487 bp, Homo sapiens; identical to SEQ ID NO: 562900
  misc_feature: HIJSMM301BY6WX.46.35.D02.1.454.light.4.raw

SEQ ID NO: 585725 - DNA, 496 bp, Homo sapiens
  misc_feature: HIJSMM301BL486.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagatttgcagttattactgtcagcagtataattactggcctcggacgttcggtccaacggaccgaacggtaggaagtcaaacgaactagtggctgcaccgatctgtcttc

SEQ ID NO: 585726 - DNA, 497 bp, Homo sapiens
  misc_feature: HIJSMM301DSIF5.13.64.F09.1.454.light.4.raw
tcacgtactacacgaccggtgctcgatttagcgcgtatacaagggggagtcagtctcagtcaggacacagcatggacatgagggtccccgctcagctcctggggctcctgctactctggctccgaggtgccagatgtgacacccagctgacccagtctcctgttttcctgtctgcctctgtgggcgacagagtcgacatcacttgccgggcaagtcagaatattaagacctatttgaattggtatcagcaaacaccagggaaagcccccaaactcctgatcttcggttcatctcgtttgcaaagtggagtcccttcacggttcagtggcagtggatctgggacagacttcactctcaccatcggcagtcttcaacgtgacgactttgcaacgtactactgtcaacagacctacagtacacctcacagttttggccaggggaccaaggtggaagtcaagggaactgtggctgcaccatctgtcttcatcttcccgcat

SEQ ID NO: 585727 - DNA, 500 bp, Homo sapiens
  misc_feature: HIJSMM301C0F5T.22.15.B04.1.454.light.4.raw
acatacgcgtcacgaccggtgctcgatttagacagtatatatccgcggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacaacacccaggcaaagcccccaaactcatgatttatgaggtcactaagcggccctcaggggtccctgatcgcttctctggctccaagtctggcaacacggcctccctgaccgtctctggctccaggctgaggatgaggctgattattactgcagctcatatggaggcagcgacaatttggtgttcggcggagggaccaagctgaccgtcctaggtcagcccaaggctgccccctcggtca

SEQ ID NO: 585728 - DNA, 498 bp, Homo sapiens; identical to SEQ ID NO: 535295
  misc_feature: HIJSMM301EUCA6.15.25.C03.1.454.light.4.raw

SEQ ID NO: 585729 - DNA, 492 bp, Homo sapiens; identical to SEQ ID NO: 537395
  misc_feature: HIJSMM301CBQVD.16.73.G07.1.454.light.4.raw

SEQ ID NO: 585730 - DNA, 500 bp, Homo sapiens
  misc_feature: HIJSMM301EWE9A.3.33.C11.1.454.light.4.raw
agacgcactccacgaccggtgctcgatttagagtgagctcgttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctcgtccccccg

SEQ ID NO: 585731 - DNA, 505 bp, Homo sapiens; identical to SEQ ID NO: 546412
  misc_feature: HIJSMM301EGMQB.22.21.B10.1.454.light.4.raw

SEQ ID NO: 585732 - DNA, 482 bp, Homo sapiens
  misc_feature: HIJSMM301DE4V3.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagtattttgcaacttactactgtcaacagagttacaataccctcggctcactttcggcggagggaccaaggtggagatcaaacgaactgtggctgcaccat

SEQ ID NO: 585733 - DNA, 494 bp, Homo sapiens
  misc_feature: HIJSMM301BZ4EV.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtctaggtcagcccaaggt

SEQ ID NO: 585734 - DNA, 490 bp, Homo sapiens
  misc_feature: HIJSMM301BMYUP.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctctactttcggcggagggaccgaaggtggagatcaaacgaact

SEQ ID NO: 585735 - DNA, 496 bp, Homo sapiens; identical to SEQ ID NO: 536828
  misc_feature: HIJSMM301BRYYD.3.71.G05.1.454.light.4.raw

SEQ ID NO: 585736 - DNA, 505 bp, Homo sapiens
  misc_feature: HIJSMM301BFDKS.5.60.F05.1.454.light.4.raw
atcagacacgcacgaccggtgctcgatttagtacgtcatcagggaaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtggctccagtctgaggatgagtctgattattactgtgcaacatgggatgacagcctgaatggtccggtattcggcggagggaccaagctgaccgtctcggtcagcccaaggctgcccctc

SEQ ID NO: 585737 - DNA, 491 bp, Homo sapiens; identical to SEQ ID NO: 535194
  misc_feature: HIJSMM301EEKND.26.78.H01.1.454.light.4.raw

SEQ ID NO: 585738 - DNA, 486 bp, Homo sapiens
  misc_feature: HIJSMM301D34AI.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctgccccctcggtcactctgttcccgccctcctcgctacgtaga

SEQ ID NO: 585739 - DNA, 509 bp, Homo sapiens
  misc_feature: HIJSMM301CZ5L4.48.87.H10.1.454.light.4.raw
agtatacatacacgaccggtgctcgatttagcagtactgcgttgggtttgggggagctacaacaggcaggcaggggcagcaagatggtgttgcagacccaggtcttcatttctctgttgctctggatctctggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcaccatcagcggcctgcaggctgaagatgtggcagtttattactgtcagcactgttttggcggttctccgactttcggcggagggaccaaggtggaggtcaaacgaacctgtggctgcaccatctgtctt

SEQ ID NO: 585740 - DNA, 520 bp, Homo sapiens; identical to SEQ ID NO: 546218
  misc_feature: HIJSMM301EFP1O.12.71.G05.1.454.light.4.raw

SEQ ID NO: 585741 - DNA, 493 bp, Homo sapiens
  misc_feature: HIJSMM301CCFDU.13.36.D03.1.454.light.4.raw
  modified_base (203)..(203): a, c, t, g, unknown or other
tcacgtactacacgaccggtgctcgatttagctgcgtcacgatctctcttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggnagagtgtcaccatctcttgttctggaggcagtgccaacatcggagtaattatgcattctggtatcaacaactcccaggaacggcccccagactcctcatctatagcaataaccagcggccctcaggggtccctgaccgattctctggctccaagtctgggaactcagccactctgaccatcagcgggacccaggctatggatgaggctgactattactgtcaggcgtgggacagcagcactgcccgctatgtcttcggaactgggaccaaggtcaccgtcctaagtcacg

SEQ ID NO: 585742 - DNA, 512 bp, Homo sapiens
  misc_feature: HIJSMM301DOM9U.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctct

SEQ ID NO: 585743 - DNA, 516 bp, Homo sapiens
  misc_feature: HIJSMM301E3I3M.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcggagggaccgaagttgaccgtcctaagtcagcccaaggctgccccctcggtcactctcgttcccaccctccctcta

SEQ ID NO: 585744 - DNA, 491 bp, Homo sapiens; identical to SEQ ID NO: 548535
  misc_feature: HIJSMM301DKUAW.51.71.G05.1.454.light.4.raw

SEQ ID NO: 585745 - DNA, 487 bp, Homo sapiens; identical to SEQ ID NO: 536206
  misc_feature: HIJSMM301EYP4O.47.38.D05.1.454.light.4.raw

SEQ ID NO: 585746 - DNA, 469 bp, Homo sapiens
  misc_feature: HIJSMM301CXXBC.51.67.G01.1.454.light.4.raw
cgatcgtatacacgaccggtgctcgatttagagtatacatattgggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcggggggaccaaggtggagatcaagcgaa

SEQ ID NO: 585747 - DNA, 484 bp, Homo sapiens; identical to SEQ ID NO: 538367
  misc_feature: HIJSMM301CUC6Z.8.14.B03.1.454.light.4.raw

SEQ ID NO: 585748 - DNA, 503 bp, Homo sapiens
  misc_feature: HIJSMM301CEEOL.47.83.H06.1.454.light.4.raw
agctcacgtacacgaccggtgctcgatttagatcacgtgcgtcgcgggggaaaggccctgaggaaaacaaaccccagctgggaagcctgagaacacttagccttcatgagtgtccccaccatggcctggatgatgcttctcctcggactccttggtttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatggcagtggcgtttgggtgttcggcggagggaccaagctgaccgtcg

SEQ ID NO: 585749 - DNA, 389 bp, Homo sapiens; identical to SEQ ID NO: 540091
  misc_feature: HIJSMM301D0231.21.40.D07.1.454.light.4.raw

SEQ ID NO: 585750 - DNA, 486 bp, Homo sapiens; identical to SEQ ID NO: 535385
  misc_feature: HIJSMM301EUKY9.19.71.G05.1.454.light.4.raw

SEQ ID NO: 585751 - DNA, 483 bp, Homo sapiens; identical to SEQ ID NO: 536691
  misc_feature: HIJSMM301DPXBE.17.26.C04.1.454.light.4.raw

SEQ ID NO: 585752 - DNA, 441 bp, Homo sapiens; identical to SEQ ID NO: 534971
  misc_feature: HIJSMM301AFBQ4.11.3.A03.1.454.light.4.raw

SEQ ID NO: 585753 - DNA, 503 bp, Homo sapiens; identical to SEQ ID NO: 539976
  misc_feature: HIJSMM301A8GAN.47.55.E11.1.454.light.4.raw

SEQ ID NO: 585754 - DNA, 517 bp, Homo sapiens
  misc_feature: HIJSMM301BAKAP.47.53.E09.1.454.light.4.raw
agctcacgtacacgaccggtgctcgatttagagagagtgtgttgggtttggggagtctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatatttttgtcaggtgtgggagactaattttggtcatatgttgttcggcggagggaccaagctgaccgtcctcggtcagcccaaggctgccccctcggtcactctgttcccgccct

SEQ ID NO: 585755 - DNA, 502 bp, Homo sapiens
  misc_feature: HIJSMM301ELIHZ.41.35.D02.1.454.light.4.raw
tctatactatcacgaccggtgctcgatttagcacacgatagttgggtttgggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataactttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgcccctcggt

SEQ ID NO: 585756 - DNA, 533 bp, Homo sapiens
  misc_feature: HIJSMM301CT5JF.12.67.G01.1.454.light.4.raw
atacgacgtacacgaccggtgctcgatttagagtatacatattggggtttggggggggtcgtcaggaggcagcgctctcgggacgtctccaccatggcctgggctctgctattcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtggaccaagctgaccgtcctaagcagcccaaggctcgccccctcggtcactctgttcccaccctctcctacg

SEQ ID NO: 585757 - DNA, 499 bp, Homo sapiens
  misc_feature: HIJSMM301DD4UL.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccacggaaccgaacggtaggagtatacagacgaaa

SEQ ID NO: 585758 - DNA, 507 bp, Homo sapiens
  misc_feature: HIJSMM301CCR69.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaaggtttccaaccgggactctggggtcccagacagattcagcggcagtgggtcaggcactgatttcacactggaaatcagcagggtggaggctgaggatgttggggtttattactgcatgcaaactacacacggccgctcactttcggcggagggaccaaggtggagatcaaacgaactgtggctgcaccatctgtt

SEQ ID NO: 585759 - DNA, 498 bp, Homo sapiens
  misc_feature: HIJSMM301C3C5Y.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacgggggcattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtggaaatcaaacgaactgtggctgcaccta

SEQ ID NO: 585760 - DNA, 508 bp, Homo sapiens; identical to SEQ ID NO: 537871
  misc_feature: HIJSMM301DKGPN.8.33.C11.1.454.light.4.raw

SEQ ID NO: 585761 - DNA, 447 bp, Homo sapiens; identical to SEQ ID NO: 535020
  misc_feature: HIJSMM301BUJUR.18.9.A09.1.454.light.4.raw

SEQ ID NO: 585762 - DNA, 499 bp, Homo sapiens
  misc_feature: HIJSMM301CUD3P.43.62.F07.1.454.light.4.raw
tgtgagtagtcacgaccggtgctcgatttagtagtcgcataaagggaaagggggcaggagtcagtctcagtcaggacacagcatggacatgagggtccccgctcagctcctggggctcctgctactctggctccgaggtgccagatgtgacatccagttgacgcagtctccatcctccctgtctgcatctgtgggagacagactcaccatcacttgccgggcaagtcagaccattaggacctatttaaattggtatcaggagaacccagggaaagcccctaagctcctgatctatgctacttccactttgcaaagtggggtcccatctaggttcagtggcagtggatcggggacacatttcactctcaccatcagtagtctgcaacctgaagattatgcaacttacttctgtcaacagagtgacagaaacccgtggacgttcggccaagggaccaaggtggaaagcaaacgaactagtggctgcaccatctgtcttcta

SEQ ID NO: 585763 - DNA, 493 bp, Homo sapiens
  misc_feature: HIJSMM301CZ63D.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgactgtgctgcaccatctgtctt

SEQ ID NO: 585764 - DNA, 508 bp, Homo sapiens
  misc_feature: HIJSMM301A5U09.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcggggcgttcggtccaacgggaccgaaggtggaaatacaaacgaactgtggctgcaccatctgtcttctatcttccccg

SEQ ID NO: 585765 - DNA, 453 bp, Homo sapiens; identical to SEQ ID NO: 563514
  misc_feature: HIJSMM301ERN17.19.86.H09.1.454.light.4.raw

SEQ ID NO: 585766 - DNA, 482 bp, Homo sapiens; identical to SEQ ID NO: 550464
  misc_feature: HIJSMM301EBO98.13.50.E06.1.454.light.4.raw

SEQ ID NO: 585767 - DNA, 497 bp, Homo sapiens
  misc_feature: HIJSMM301A14TS.52.10.A10.1.454.light.4.raw
cgcagtacgacacgaccggtgctcgatttagcgtcgatctcagggggaggaactgctcagttaggacccagagggaaccatggaagccccagctcagcttctcttcctcctgctactctggctcccagatggtaccggagaaagtgtattgacacagtctccagacaccctgtctttgtctccaggagagagggccaccctctcctgcagggccagtcagaatattacctcttacctggcctggtaccaacaaaaacctgcccaggctcccaggctcctcatctatgatgcatccaatcgggccactggcatcccagccaggttcagtggcagtgggtctgggacagacttcactctcaccatcagcaacctagagcctgaagactttgcagtttattactgtcagcagcgtagtaagtggcgcttcggccaagggacacggactgggaggttaaacgaactgtggctgcaccatctgtcttcatccttcccgccat

SEQ ID NO: 585768 - DNA, 509 bp, Homo sapiens; identical to SEQ ID NO: 544573
  misc_feature: HIJSMM301AS978.10.88.H11.1.454.light.4.raw

SEQ ID NO: 585769 - DNA, 480 bp, Homo sapiens; identical to SEQ ID NO: 535630
  misc_feature: HIJSMM301CMTC0.40.59.F04.1.454.light.4.raw

SEQ ID NO: 585770 - DNA, 522 bp, Homo sapiens
  misc_feature: HIJSMM301EQO5Q.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctacaaaaatcggaagtcgttatgtatactggttccagcagctcccaggaaccggcccccaaactcctcatctataggaataatcagccggccctcaggggtccctgaccgattctctggctccaaggctggcacctcagccctccctggccatcagtgggctccggtccgaggatgaggctgattattactgtgcagcatgggatgacagcctgagtggtccttgggtgttcggcggagggaccaagctgaccgtcctaagtcagcccaaggctgccccctcggtcactctcgttccccaccctcctccg

SEQ ID NO: 585771 - DNA, 495 bp, Homo sapiens; identical to SEQ ID NO: 535486
  misc_feature: HIJSMM301CU0AT.26.72.G06.1.454.light.4.raw

SEQ ID NO: 585772 - DNA, 503 bp, Homo sapiens
  misc_feature: HIJSMM301C4NKC.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcgg

SEQ ID NO: 585773 - DNA, 521 bp, Homo sapiens; identical to SEQ ID NO: 536990
  misc_feature: HIJSMM301CAU4R.27.23.C01.1.454.light.4.raw
  modified_base (517)..(517): a, c, t, g, unknown or other

SEQ ID NO: 585774 - DNA, 502 bp, Homo sapiens
  misc_feature: HIJSMM301D72D4.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggcccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaactccactgtc

SEQ ID NO: 585775 - DNA, 495 bp, Homo sapiens; identical to SEQ ID NO: 573631
  misc_feature: HIJSMM301ADZS9.26.12.B01.1.454.light.4.raw

SEQ ID NO: 585776 - DNA, 481 bp, Homo sapiens
  misc_feature: HIJSMM301D4WIF.10.74.G08.1.454.light.4.raw
catagtagtgcacgaccggtgctcgatttagtagctctatcagggggaggaactgctcagttaggacccagacggaaccatggaagccccagcgcagcttctcttcctcctgctactcgtggctcccagataccactggagaaatagtgatgacgcagtctccagccaccctgtctgtgtctccaggggaaggagccaccctctcctgcagggccagtcagagtattagcagcaacttagcctggtaccagcagaaacctggccagtctcccaggctcctcctctatgatgcatccaccagggccactggtatcccagccaggttcagtggcagtgggtctgggacagagttcactctcaccatcagcagcctgcagtctgaggatattgcagtttattactgtcagcagtatactaactggcctactgacggttcggccaagggaccagggtggaaatcaaacgaactgtgctgcaccat

SEQ ID NO: 585777 - DNA, 507 bp, Homo sapiens; identical to SEQ ID NO: 535641
  misc_feature: HIJSMM301BVCAL.10.88.H11.1.454.light.4.raw

SEQ ID NO: 585778 - DNA, 520 bp, Homo sapiens; identical to SEQ ID NO: 538570
  misc_feature: HIJSMM301A1ZW9.27.23.C01.1.454.light.4.raw

SEQ ID NO: 585779 - DNA, 495 bp, Homo sapiens; identical to SEQ ID NO: 543094
  misc_feature: HIJSMM301CLV8T.22.57.F02.1.454.light.4.raw

SEQ ID NO: 585780 - DNA, 505 bp, Homo sapiens
  misc_feature: HIJSMM301BHNZW.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtctaagtcagcccaaggccaaccccactgtcactctgttcccaccctt

SEQ ID NO: 585781 - DNA, 489 bp, Homo sapiens
  misc_feature: HIJSMM301CK2TU.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccagggaccgaaggtggaagtcaagcgaactgtggctgcaccatctgtt

SEQ ID NO: 585782 - DNA, 499 bp, Homo sapiens
  misc_feature: HIJSMM301BY47R.15.3.A03.1.454.light.4.raw
tctacgtagccacgaccggtgctcgatttagagagcgtcacagggggctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaataagaactacttagcttggtatcagaaaaaccaggacagcctcctaagctgctcatttactgggcatctacccgggaatccggggtccctgaccgattcagtggcagcgggtctggcacagatttcactctcaccatcagcagcctgcaggctgaagatgtggctagtttattactgtcagacaatatagaaagttactttccttttactttcggtcccttgggaccaaagtggatatcaaacgaactgtggctgcaccat

SEQ ID NO: 585783 - DNA, 505 bp, Homo sapiens; identical to SEQ ID NO: 538422
  misc_feature: HIJSMM301A4ZXO.19.78.H01.1.454.light.4.raw

SEQ ID NO: 585784 - DNA, 506 bp, Homo sapiens; identical to SEQ ID NO: 536355
  misc_feature: HIJSMM301DJT1F.47.85.H08.1.454.light.4.raw

SEQ ID NO: 585785 - DNA, 444 bp, Homo sapiens; identical to SEQ ID NO: 534993
  misc_feature: HIJSMM301AGAE1.5.9.A09.1.454.light.4.raw

SEQ ID NO: 585786 - DNA, 501 bp, Homo sapiens; identical to SEQ ID NO: 536142
  misc_feature: HIJSMM301EM2LX.15.1.A01.1.454.light.4.raw

SEQ ID NO: 585787 - DNA, 522 bp, Homo sapiens
  misc_feature: HIJSMM301C1B8V.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaacgggaccgaacggtaggaaggtacgaaacgaactacggtaggcgtcgcaccactctgtcttctactcttcccgtccact

SEQ ID NO: 585788 - DNA, 521 bp, Homo sapiens; identical to SEQ ID NO: 539470
  misc_feature: HIJSMM301DY2FD.27.23.C01.1.454.light.4.raw

SEQ ID NO: 585789 - DNA, 504 bp, Homo sapiens
  misc_feature: HIJSMM301A97ON.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcaactactgtcgttggtgttcggcggaggaccaagttgaccgtcctaggtcagccaaggctgccccctcggtcactctgtt

SEQ ID NO: 585790 - DNA, 513 bp, Homo sapiens
  misc_feature: HIJSMM301CGJAX.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctggtcactctgttccccg

SEQ ID NO: 585791 - DNA, 502 bp, Homo sapiens; identical to SEQ ID NO: 541971
  misc_feature: HIJSMM301DL7UV.4.39.D06.1.454.light.4.raw

SEQ ID NO: 585792 - DNA, 422 bp, Homo sapiens; identical to SEQ ID NO: 539599
  misc_feature: HIJSMM301DVQGH.9.25.C03.1.454.light.4.raw

SEQ ID NO: 585793 - DNA, 494 bp, Homo sapiens; identical to SEQ ID NO: 535680
  misc_feature: HIJSMM301ELVHD.16.78.H01.1.454.light.4.raw

SEQ ID NO: 585794 - DNA, 497 bp, Homo sapiens; identical to SEQ ID NO: 540675
  misc_feature: HIJSMM301DIKZV.48.59.F04.1.454.light.4.raw

SEQ ID NO: 585795 - DNA, 505 bp, Homo sapiens
  misc_feature: HIJSMM301A41IZ.18.26.C04.1.454.light.4.raw
tacgagtatgcacgaccggtgctcgatttagtctagcgactttgggtttgggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccgaaggtagagatacaaaggaactagtggctgcaccatctgtcttcatcttcccgccta

SEQ ID NO: 585796 - DNA, 503 bp, Homo sapiens
  misc_feature: HIJSMM301DH1ZN.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgacccgtctctgggctccaggctgacgatgaggctgattattactgcagctcatatgcaggcacccacaatgtcttcggaagtgggaccacggtcaccgtcctaggtcagcccaaggccaaccccactcgtcact

SEQ ID NO: 585797 - DNA, 513 bp, Homo sapiens; identical to SEQ ID NO: 571743
  misc_feature: HIJSMM301BUTVD.13.81.H04.1.454.light.4.raw

SEQ ID NO: 585798 - DNA, 454 bp, Homo sapiens; identical to SEQ ID NO: 536325
  misc_feature: HIJSMM301CQDY3.19.86.H09.1.454.light.4.raw
  modified_base (436)..(436): a, c, t, g, unknown or other

SEQ ID NO: 585799 - DNA, 490 bp, Homo sapiens
  misc_feature: HIJSMM301BNV40.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggacccgaaggtgggataatcagacgaa

SEQ ID NO: 585800 - DNA, 505 bp, Homo sapiens
  misc_feature: HIJSMM301DJ143.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtggaaatacaaacgaactagtggctgcaccatctgtcttcatcttccccg

SEQ ID NO: 585801 - DNA, 502 bp, Homo sapiens
  misc_feature: HIJSMM301EJDTM.43.69.G03.1.454.light.4.raw
tgtgagtagtcacgaccggtgctcgatttagtcgctgcgtaaaggagaaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctgccccctcggtcac

SEQ ID NO: 585802 - DNA, 499 bp, Homo sapiens; identical to SEQ ID NO: 547044
  misc_feature: HIJSMM301D6IOL.43.71.G05.1.454.light.4.raw

SEQ ID NO: 585803 - DNA, 485 bp, Homo sapiens
  misc_feature: HIJSMM301AI3YS.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacagtcccgctcactttcggcggagggaccgaaggtggagatacaaacgaa

SEQ ID NO: 585804 - DNA, 512 bp, Homo sapiens
  misc_feature: HIJSMM301C2DC3.22.36.D03.1.454.light.4.raw
acatacgcgtcacgaccggtgctcgatttagctgcgtcacgatctctcttggggggggtctcaggaggcagcgctctcgggacgtctccaccatggcctgggctctgctattcctcaccttcctcactcagggcacagggtcctgggcccagtctgccctgacccagcctgcctccgtgtctggatcatctggacagtcgatcagcatttcctgcactgggaccaacagtgacattgggtcttttgactctgtctcctggtaccaacaacacccaggcaaacccccccaactcatcatttatggtgtcactcgtcggccctcaggagtctctcatcgcttctcaggctccaagtctggcaacacggcctccctaaccatctctgggctccagtttgaggacgagtctacttattactgcagttcctttaaattaggcgccactctcgtggttttcggcggaggcaccgaagtgaccgtcctcggtcagcccaaggctgccccctcggtcact

SEQ ID NO: 585805 - DNA, 501 bp, Homo sapiens; identical to SEQ ID NO: 537690
  misc_feature: HIJSMM301BGT5R.41.14.B03.1.454.light.4.raw

SEQ ID NO: 585806 - DNA, 506 bp, Homo sapiens; identical to SEQ ID NO: 549591
  misc_feature: HIJSMM301ASAC2.17.87.H10.1.454.light.4.raw

SEQ ID NO: 585807 - DNA, 503 bp, Homo sapiens; identical to SEQ ID NO: 537216
  misc_feature: HIJSMM301A1RLM.3.70.G04.1.454.light.4.raw

SEQ ID NO: 585808 - DNA, 485 bp, Homo sapiens
  misc_feature: HIJSMM301B52VU.40.37.D04.1.454.light.4.raw
tctagcgactcacgaccggtgctcgatttagtagcatactgttgggtttgggggatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggagtgccagataggttcagtggcagcgggtcagtgacagatttcacactgaaaatcagccgggtggaggctgaggatgttgggtttattactgcatgcaagctctacaaattcctcggacgtcgccgaaggaccgaaggtaggaaatacaaacgaact

SEQ ID NO: 585809 - DNA, 445 bp, Homo sapiens; identical to SEQ ID NO: 567502
  misc_feature: HIJSMM301CMZNM.5.9.A09.1.454.light.4.raw

SEQ ID NO: 585810 - DNA, 486 bp, Homo sapiens; identical to SEQ ID NO: 535043
  misc_feature: HIJSMM301AP1WO.46.35.D02.1.454.light.4.raw

SEQ ID NO: 585811 - DNA, 500 bp, Homo sapiens; identical to SEQ ID NO: 535310
  misc_feature: HIJSMM301E0UKF.47.66.F11.1.454.light.4.raw

SEQ ID NO: 585812 - DNA, 504 bp, Homo sapiens; identical to SEQ ID NO: 538940
  misc_feature: HIJSMM301DYLIY.2.35.D02.1.454.light.4.raw

SEQ ID NO: 585813 - DNA, 506 bp, Homo sapiens; identical to SEQ ID NO: 544918
  misc_feature: HIJSMM301EZAU7.8.1.A01.1.454.light.4.raw

SEQ ID NO: 585814 - DNA, 454 bp, Homo sapiens; identical to SEQ ID NO: 534964
  misc_feature: HIJSMM301AEAQK.19.86.H09.1.454.light.4.raw

SEQ ID NO: 585815 - DNA, 516 bp, Homo sapiens
  misc_feature: HIJSMM301B8V64.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtggaccaagctgaccgtcctaagtcagcccaaggctcgccccctcggtcactctgttccca

SEQ ID NO: 585816 - DNA, 493 bp, Homo sapiens; identical to SEQ ID NO: 535084
  misc_feature: HIJSMM301DR5HQ.47.64.F09.1.454.light.4.raw

SEQ ID NO: 585817 - DNA, 490 bp, Homo sapiens
  misc_feature: HIJSMM301ASRTM.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccatgtctggcaacacggcctccctgaccgtctctgggctccagcctgaggatgaggctgattattactgcagctcatatgcaggcatcaacactgttttcggcggagggaccaaggctgaccgtcctaggtcagcccaaggctgccccctcggtcactctgttcccaccctcctccga

SEQ ID NO: 585818 - DNA, 505 bp, Homo sapiens; identical to SEQ ID NO: 538422
  misc_feature: HIJSMM301DILBT.19.78.H01.1.454.light.4.raw

SEQ ID NO: 585819 - DNA, 479 bp, Homo sapiens
  misc_feature: HIJSMM301BKBUQ.49.85.H08.1.454.light.4.raw
agtcgagagacacgaccggtgctcgatttagtatcactcagtcgcggggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcacttcggcgagggaccacggtgaggatcaaacgaactgtggctgcaccat

SEQ ID NO: 585820 - DNA, 506 bp, Homo sapiens
  misc_feature: HIJSMM301AEHR2.12.86.H09.1.454.light.4.raw
atacgacgtacacgaccggtgctcgatttagtgctatagacttgggtttggggaggaactgctcagttaggacccagagggaaccatggaagccccagctcagcttctcttcctcctgctactctggctcccaggtgccaccggagaaattctgttgacacagtctccagccaccctgtctttgtctccaggggaaagagccaccttctcctgcagggccagtcagagtcttagcacctacttagcctggtaccaacagaaacctggccaggctcccaggctcctcatctatgatgcatccaaaagggccactggcatcccagccaggttcagtggcagtggggtctggggcagacttcactctcaccatcagcagcctagagcctgaagattttgtcagtttattactgtcagcagcgtagcaactggcctcggttcactttggtccacggggaccgaagactggaggatcaaacgaaactagtggctgcaccatctgtcttcat

SEQ ID NO: 585821 - DNA, 507 bp, Homo sapiens
  misc_feature: HIJSMM301DDTE6.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaaggctgaccgtcctaggtcagccaaggctgccccccg

SEQ ID NO: 585822 - DNA, 495 bp, Homo sapiens; identical to SEQ ID NO: 539805
  misc_feature: HIJSMM301A19E4.9.1.A01.1.454.light.4.raw

SEQ ID NO: 585823 - DNA, 508 bp, Homo sapiens; identical to SEQ ID NO: 543419
  misc_feature: HIJSMM301B3PMP.4.10.A10.1.454.light.4.raw

SEQ ID NO: 585824 - DNA, 527 bp, Homo sapiens
  misc_feature: HIJSMM301DKC72.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtgtccgacggaccgaacggtaggaaggtacaaacgaacgtacgtaggacgtgcgaccactctcgtcttctactacttccgtcctactctcgta

SEQ ID NO: 585825 - DNA, 521 bp, Homo sapiens
  misc_feature: HIJSMM301DQWPN.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgtcct

SEQ ID NO: 585826 - DNA, 492 bp, Homo sapiens
  misc_feature: HIJSMM301AFID1.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacgaactgacaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaa

SEQ ID NO: 585827 - DNA, 482 bp, Homo sapiens
  misc_feature: HIJSMM301BDEW0.4.57.F02.1.454.light.4.raw
agcactgtagcacgaccggtgctcgatttagctcgatatagttgggtttggggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaaccagggaaagcccctaagctcctgatctatgctgcatccagtttacaaagtggggtcccatcaagattcagtggcagtggatctgggacagatttcactctcaccatcagtagtctacaacctgaagattttgcaacttactactgtcaacagagttacgataccctcgctcactttcgcggaggaccgaaggtggagatcaaacgaactgtgctgcac

SEQ ID NO: 585828 - DNA, 464 bp, Homo sapiens; identical to SEQ ID NO: 575760
  misc_feature: HIJSMM301CPB0P.43.75.G09.1.454.light.4.raw

SEQ ID NO: 585829 - DNA, 518 bp, Homo sapiens
  misc_feature: HIJSMM301ASMVI.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgtccgacggaccgaacggtaggaaggtacgaacgaactacgtaggcgtgcgaccatctgtcttctactcttcccgtcccact

SEQ ID NO: 585830 - DNA, 506 bp, Homo sapiens; identical to SEQ ID NO: 543993
  misc_feature: HIJSMM301D2SA1.18.78.H01.1.454.light.4.raw

SEQ ID NO: 585831 - DNA, 494 bp, Homo sapiens; identical to SEQ ID NO: 534994
  misc_feature: HIJSMM301DU3G3.27.78.H01.1.454.light.4.raw

SEQ ID NO: 585832 - DNA, 484 bp, Homo sapiens; identical to SEQ ID NO: 535211
  misc_feature: HIJSMM301BK2X7.47.46.E02.1.454.light.4.raw

SEQ ID NO: 585833 - DNA, 513 bp, Homo sapiens
  misc_feature: HIJSMM301CQIQD.43.5.A05.1.454.light.4.raw
tgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttggggcaaagctgccctgaccctttcgggtgcgcagcctgaggatgaggctgactattactgcttgctcgcctatgatgctgctcgggttttcgcggagggaccaagttgaccgtcctaggtcagcccaaggctgccccctccggtcactctgttcccaccctccctcta

SEQ ID NO: 585834 - DNA, 496 bp, Homo sapiens; identical to SEQ ID NO: 551761
  misc_feature: HIJSMM301CUV1Z.4.27.C05.1.454.light.4.raw

SEQ ID NO: 585835 - DNA, 491 bp, Homo sapiens; identical to SEQ ID NO: 535176
  misc_feature: HIJSMM301ESDHQ.13.39.D06.1.454.light.4.raw

SEQ ID NO: 585836 - DNA, 487 bp, Homo sapiens; identical to SEQ ID NO: 536206
  misc_feature: HIJSMM301DR9HD.47.38.D05.1.454.light.4.raw

SEQ ID NO: 585837 - DNA, 496 bp, Homo sapiens; identical to SEQ ID NO: 537925
  misc_feature: HIJSMM301EESAW.22.14.B03.1.454.light.4.raw

SEQ ID NO: 585838 - DNA, 487 bp, Homo sapiens; identical to SEQ ID NO: 536206
  misc_feature: HIJSMM301BEC5Y.47.38.D05.1.454.light.4.raw

SEQ ID NO: 585839 - DNA, 521 bp, Homo sapiens
  misc_feature: HIJSMM301BLPBF.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccagggctgaccgtcctaggtcagcccaaggctgccccctcggtcactctgttcccgcct

SEQ ID NO: 585840 - DNA, 510 bp, Homo sapiens; identical to SEQ ID NO: 553863
  misc_feature: HIJSMM301BCSU8.16.46.E02.1.454.light.4.raw

SEQ ID NO: 585841 - DNA, 516 bp, Homo sapiens
  misc_feature: HIJSMM301CO7J9.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtgtgggagactaattttggtcatatgttgttcggcggaggaccaagctgaccgtcctcggtcagcccaaggctgccccctcggtcactctgttcccaccctcctc

SEQ ID NO: 585842 - DNA, 420 bp, Homo sapiens
  misc_feature: HIJSMM301AYR49.19.86.H09.1.454.light.4.raw
tactctcgtgcacgaccggtgctcgatttagtgctatagacttgggtttgggggccgttcctgggactttctgataccacatcacaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcgggagggaccaagctgaccgtcctaagtcagcccaaggctcgcccctcggtcactctcgttcccgccctcctccacgagagta

SEQ ID NO: 585843 - DNA, 460 bp, Homo sapiens
  misc_feature: HIJSMM301CC6FE.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatactcatgtgtactggtaccaacaggtcccagggacggtccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 585844 - DNA, 487 bp, Homo sapiens; identical to SEQ ID NO: 536206
  misc_feature: HIJSMM301BHWFV.47.38.D05.1.454.light.4.raw

SEQ ID NO: 585845 - DNA, 461 bp, Homo sapiens
  misc_feature: HIJSMM301EHB73.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtcctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 585846 - DNA, 491 bp, Homo sapiens; identical to SEQ ID NO: 536988
  misc_feature: HIJSMM301BWSUY.17.21.B10.1.454.light.4.raw

SEQ ID NO: 585847 - DNA, 489 bp, Homo sapiens; identical to SEQ ID NO: 569361
  misc_feature: HIJSMM301A1A89.3.55.E11.1.454.light.4.raw

SEQ ID NO: 585848 - DNA, 385 bp, Homo sapiens
  misc_feature: HIJSMM301CRLEQ.48.57.F02.1.454.light.4.raw
agtatacatacacgaccggtgctcgatttagctcgatatagttgggtttgggggagctacaacaggcaggcaggggcagcaagatggtgttgcagacccaggtcttcatttctctgttgctctggatctcgtggtgcctacggggacatcgtgatgaaccagtctccagagtccctggctgtgtctctgggcgagagggccaccatctactgcaagtccagccagagtctttttcacacaaccaatgagaagaactacttagcttggtaccagcagagaccaggacaacctcctaagttgctcttttactgggcgtcttcccgggagtccggggtccctgaccgattcagtgccagcgggtctgggacagacttcactctcacca

SEQ ID NO: 585849 - DNA, 508 bp, Homo sapiens
  misc_feature: HIJSMM301DQ2OF.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacattttttcttggtttttggcggcgggacccagatgactgtcctcagtcagcccaaggctgccccctcggt

SEQ ID NO: 585850 - DNA, 509 bp, Homo sapiens; identical to SEQ ID NO: 539359
  misc_feature: HIJSMM301DSQ71.47.85.H08.1.454.light.4.raw

SEQ ID NO: 585851 - DNA, 503 bp, Homo sapiens
  misc_feature: HIJSMM301CVDUR.21.81.H04.1.454.light.4.raw
  modified_base (375)..(375): a, c, t, g, unknown or other
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtctttatgactatgtctcctggtaccaacaatacccaggcaaagcccccaaactcatcatttatgatgtcagtaatcggccctcaggggtttctaatcgcttctctggctccaagtctggcaacacggctccctgaccatcnctgggctccaggctgatgacgaggctgattattactgcaggtcatatacaatcagcaacacttatgtcttcgggactgggaccaagatcaccgtcctaggtcagcccaaggccaaccccactcgtcta

SEQ ID NO: 585852 - DNA, 512 bp, Homo sapiens
  misc_feature: HIJSMM301DWVK8.43.59.F04.1.454.light.4.raw
tgtgagtagtcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggcctgccccctcggtcact

SEQ ID NO: 585853 - DNA, 518 bp, Homo sapiens; identical to SEQ ID NO: 559538
  misc_feature: HIJSMM301DNIOL.3.87.H10.1.454.light.4.raw

SEQ ID NO: 585854 - DNA, 498 bp, Homo sapiens; identical to SEQ ID NO: 535469
  misc_feature: HIJSMM301DG8VA.12.18.B07.1.454.light.4.raw

SEQ ID NO: 585855 - DNA, 485 bp, Homo sapiens; identical to SEQ ID NO: 535606
  misc_feature: HIJSMM301AK1SO.47.46.E02.1.454.light.4.raw

SEQ ID NO: 585856 - DNA, 495 bp, Homo sapiens; identical to SEQ ID NO: 535486
  misc_feature: HIJSMM301CT0X6.26.72.G06.1.454.light.4.raw

SEQ ID NO: 585857 - DNA, 496 bp, Homo sapiens; identical to SEQ ID NO: 535109
  misc_feature: HIJSMM301AJCX7.16.78.H01.1.454.light.4.raw

SEQ ID NO: 585858 - DNA, 508 bp, Homo sapiens
  misc_feature: HIJSMM301DGXG2.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccgaaggtaggaatacaaacgaactagtggctgcaccactctgtcttctactcttccccg

SEQ ID NO: 585859 - DNA, 495 bp, Homo sapiens
  misc_feature: HIJSMM301C2VKG.27.78.H01.1.454.light.4.raw
  modified_base (463)..(463): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcacggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaacgaactgtggctgcaccatctgtctt

SEQ ID NO: 585860 - DNA, 554 bp, Homo sapiens
  misc_feature: HIJSMM301B8Y2G.17.25.C03.1.454.light.4.raw
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcacccgctttatcgttacttatgtcagcattcgcacttctgatacctccagcatgcctcacagcacaccttcacaggcttacagaacgctccccctacccaacaacgcataagcgtcgctgccgcagcttcggtgcatggtttagccccgtttcatcttcccgccatctgactagtctacg

SEQ ID NO: 585861 - DNA, 512 bp, Homo sapiens; identical to SEQ ID NO: 556615
  misc_feature: HIJSMM301AZDXA.19.59.F04.1.454.light.4.raw

SEQ ID NO: 585862 - DNA, 504 bp, Homo sapiens
  misc_feature: HIJSMM301DGDM0.48.73.G07.1.454.light.4.raw
agtatacatacacgaccggtgctcgatttagctctacgctcagggcacgaccggtgctcgatttagtctgatcgagaagggaaagggggaggaactgctcagttaggacccagacggaaccatggaagccccagcgcagcttctcttcctcctgctactctggctcccagatgtcactggagaaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgttcagcactataataactggccacgtggacgttcggaccg

SEQ ID NO: 585863 - DNA, 484 bp, Homo sapiens
  misc_feature: HIJSMM301AOADI.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggattttgcaacttattactgtctacaagattacacttaccctgggacgttcggccgaaggaccgaaggtggaaatacaaacgaactagtggctgcaccta

SEQ ID NO: 585864 - DNA, 497 bp, Homo sapiens; identical to SEQ ID NO: 536371
  misc_feature: HIJSMM301EANXF.16.78.H01.1.454.light.4.raw

SEQ ID NO: 585865 - DNA, 486 bp, Homo sapiens; identical to SEQ ID NO: 535290
  misc_feature: HIJSMM301B1WMS.3.12.B01.1.454.light.4.raw

SEQ ID NO: 585866 - DNA, 486 bp, Homo sapiens; identical to SEQ ID NO: 535458
  misc_feature: HIJSMM301DQ6VW.7.75.G09.1.454.light.4.raw

SEQ ID NO: 585867 - DNA, 504 bp, Homo sapiens; identical to SEQ ID NO: 561069
  misc_feature: HIJSMM301EFYGT.19.78.H01.1.454.light.4.raw

SEQ ID NO: 585868 - DNA, 471 bp, Homo sapiens
  misc_feature: HIJSMM301CONNZ.11.70.G04.1.454.light.4.raw
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacaggatttcactctcaccatcagcagcctgcagcctgaagatgttgcaacttattactgtacaaaagaatagcgctgccccgctcagtttcggcggagggaccaaggtggagataaccg

SEQ ID NO: 585869 - DNA, 502 bp, Homo sapiens
  misc_feature: HIJSMM301BFJVA.5.86.H09.1.454.light.4.raw
atcagacacgcacgaccggtgctcgatttagtgctatagacttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcgggcggagggaccaagctgaccgtctaggtcagcccaaggctcgccccctc

SEQ ID NO: 585870 - DNA, 521 bp, Homo sapiens
  misc_feature: HIJSMM301DH47R.17.42.D09.1.454.light.4.raw
cgtagactagcacgaccggtgctcgatttagacacatacgcagggaaagggggccccagctctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccacctt

SEQ ID NO: 585871 - DNA, 503 bp, Homo sapiens
  misc_feature: HIJSMM301C53LT.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatcaaacgaacagtggctgcaccatctgtcttcactcttccccg

SEQ ID NO: 585872 - DNA, 495 bp, Homo sapiens
  misc_feature: HIJSMM301ALSJQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagtcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 585873 - DNA, 501 bp, Homo sapiens; identical to SEQ ID NO: 540528
  misc_feature: HIJSMM301AX0O0.11.31.C09.1.454.light.4.raw

SEQ ID NO: 585874 - DNA, 494 bp, Homo sapiens; identical to SEQ ID NO: 534992
  misc_feature: HIJSMM301DYDKT.9.1.A01.1.454.light.4.raw

SEQ ID NO: 585875 - DNA, 526 bp, Homo sapiens
  misc_feature: HIJSMM301C2S67.52.7.A07.1.454.light.4.raw
  modified_base (504)..(504): a, c, t, g, unknown or other
cgcagtacgacacgaccggtgctcgatttagcacgtgtcgcaggggggggtcacaagaggcagcgctctcgggacgtctccaccatggcctgggctctgctgctcctcaccctcctcactcaggacacagggtcctgggcccagtctgccctggctcaacctgcctccgtgtctgggtctcctggacagtcgatcaccatctcctgcgccggaaccaacaatgatgttgggagttataaacttgtctcctggtaccaacaacaccccggcaaagcccccaaactcatcatttatgaggtcactaagcggccctcgggggtttctaatcgcttctctggctccaagtctggcgacacggcctccctgacaatctcttggctccaggctgaggacgaggctgattatttttgctgctcatatgcgggtagtagtaattatgtcttcggaagtgggaccacggtcaccgtcctgggtcagcccaaggccaaccccactgtcactctnttcccgccctcctcctatacga

SEQ ID NO: 585876 - DNA, 509 bp, Homo sapiens; identical to SEQ ID NO: 541168
  misc_feature: HIJSMM301EDTWK.5.60.F05.1.454.light.4.raw

SEQ ID NO: 585877 - DNA, 513 bp, Homo sapiens
  misc_feature: HIJSMM301AZ7EL.3.87.H10.1.454.light.4.raw
agacgcactccacgaccggtgctcgatttagcagtactgcgttgggtttgggggggtctcaggaggcagcgctctcgggacgtctccaccatggcctgggctctgctattcctcaccctcctcactcagggcacagggtcctgggcccagcctgccctgactcagcctgcctccgtgtctgggtctcctggacagtcggtcaccatctcctgcactggatccaccggtgacgttgctacttataagtttgtctcctggtcctggtaccaaaaacacccaggcaaagcccccagattaatgatttatgatgtcagtgatcggccctcaggggtttctcatcgcttttctggctccaagtctggcaacacggcctccctgaccatctctgggctccaggctgaggacgaggctgattatttctgcagctcatatacaaggagcaccactctcgtggtatttggtggagggaccaagctgaccgtcctaggtcagcccaaggcctgccccctcggt

SEQ ID NO: 585878 - DNA, 463 bp, Homo sapiens
  misc_feature: HIJSMM301BOX1T.40.2.A02.1.454.light.4.raw
tctagcgactcacgaccggtgctcgatttagactcatctacagggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcggacttttggtccaggggacctggctggagatcaaacgaa

SEQ ID NO: 585879 - DNA, 484 bp, Homo sapiens; identical to SEQ ID NO: 535211
  misc_feature: HIJSMM301DYAYP.47.46.E02.1.454.light.4.raw

SEQ ID NO: 585880 - DNA, 490 bp, Homo sapiens
  misc_feature: HIJSMM301BKFET.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagccctgcaggctgaagatgtggcagtttattattgtcaacaatattattatacttcgtggacgttcggccaacgggaccaaggtggatatcagacgaa

SEQ ID NO: 585881 - DNA, 479 bp, Homo sapiens
  misc_feature: HIJSMM301CGKUZ.41.5.A05.1.454.light.4.raw
tctatactatcacgaccggtgctcgatttagatagatagacaggggcaggagtcagacccagtcaggacacagcatggaacatgagggtccccgctcagctcctggggctcctgctgctctggttcccaggttccagatgcgacatccagctgacccagtctccatcttctgtgtctgcatctgtaggagacagagtcaacatcacttgtcgggcgagtcagggtattaccagctggttagcctggtatcagcagaaaccagggaaagcccctaaactcctgatctatgctgcatccagtttgcaaagtggggtcccatcaagattcagaggcagtggatctgggacagatttcactctcactatcaacagcctgcagcctgaagattttgccacttactattgtcaacaggctgacagtttccccttcaccttcggccaagggacacgactggacattaaacgaactgtggctgcacc

SEQ ID NO: 585882 - DNA, 483 bp, Homo sapiens; identical to SEQ ID NO: 535413
  misc_feature: HIJSMM301DGAGT.26.78.H01.1.454.light.4.raw

SEQ ID NO: 585883 - DNA, 448 bp, Homo sapiens
  misc_feature: HIJSMM301C2DVO.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactagtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctcgttcccgccctcctccatactcgta

SEQ ID NO: 585884 - DNA, 495 bp, Homo sapiens; identical to SEQ ID NO: 544003
  misc_feature: HIJSMM301D4RDE.3.31.C09.1.454.light.4.raw

SEQ ID NO: 585885 - DNA, 514 bp, Homo sapiens
  misc_feature: HIJSMM301CK6ZD.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtccactctcgttcccaccctcctccgctacgt

SEQ ID NO: 585886 - DNA, 520 bp, Homo sapiens
  misc_feature: HIJSMM301CBI7A.41.18.B07.1.454.light.4.raw
  modified_base (505)..(505): a, c, t, g, unknown or other
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcaggtggttcttagtcgggttggttcggggccgggggacgaagctaggaccgtccgtacggtcacgccgaacggctcggccccctcggtccnctctcgttccccccg

SEQ ID NO: 585887 - DNA, 500 bp, Homo sapiens
  misc_feature: HIJSMM301C21KY.10.36.D03.1.454.light.4.raw
catagtagtgcacgaccggtgctcgatttagctgcgtcacgatctctcttggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaatgtcgggagagataatgtgtactggtaccagcaggtcccaggaacggcccccaaactcctcatctataacgattatcggcggccctcaggggtccctgaccgattctctggctccaagtctggcacctcagcctccctggccatcagtgggctccggtccgaggatgacgctgattattactgtgtagcatgggatgacagcctgagtgcttatgtcttcggaactgggaccaaggtcaccgtcctacgtcagcccaaggcccaacccactgtca

SEQ ID NO: 585888 - DNA, 484 bp, Homo sapiens; identical to SEQ ID NO: 559590
  misc_feature: HIJSMM301BD47N.49.81.H04.1.454.light.4.raw

SEQ ID NO: 585889 - DNA, 511 bp, Homo sapiens; identical to SEQ ID NO: 537047
  misc_feature: HIJSMM301B4MDR.5.27.C05.1.454.light.4.raw

SEQ ID NO: 585890 - DNA, 520 bp, Homo sapiens; identical to SEQ ID NO: 535773
  misc_feature: HIJSMM301D1UIR.41.19.B08.1.454.light.4.raw

SEQ ID NO: 585891 - DNA, 492 bp, Homo sapiens; identical to SEQ ID NO: 535126
  misc_feature: HIJSMM301BK3JD.18.11.A11.1.454.light.4.raw

SEQ ID NO: 585892 - DNA, 497 bp, Homo sapiens; identical to SEQ ID NO: 535664
  misc_feature: HIJSMM301DI32M.22.14.B03.1.454.light.4.raw

SEQ ID NO: 585893 - DNA, 513 bp, Homo sapiens
  misc_feature: HIJSMM301D27XD.16.83.H06.1.454.light.4.raw
tgtactactccacgaccggtgctcgatttagatcacgtgcgtcgcggggagtctgggcctaaggaagcagcactggtggtgcctcagccatggcctggaccgttctcctcctcggcctcctctctcactgcacaggctctgtgacctcctatgtcctgactcagccaccctcggtgtccgtggccccaggacagacggccagcataacctgtgggggaaacggccttggacgtaaaagtgtgcactggtaccagcagaagccaggccaggcccctgtgctggtcgtctatgatgatagcgaccggccctcagggatccctgagcgattctctggctccaactctgggaacgcggccaccctgaccatcagcagggtcgaagccggggatgaggccgactattactgtcaggtgtgggatagtagtagtgatcattatgtcttcggatctgggaccagggtcaccgtcctaggtcagtccaaggccaaccccactgtcactctgttcccgccct

SEQ ID NO: 585894 - DNA, 479 bp, Homo sapiens; identical to SEQ ID NO: 535586
  misc_feature: HIJSMM301DG8W9.13.34.D01.1.454.light.4.raw

SEQ ID NO: 585895 - DNA, 476 bp, Homo sapiens
  misc_feature: HIJSMM301DIMF6.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagta

SEQ ID NO: 585896 - DNA, 497 bp, Homo sapiens; identical to SEQ ID NO: 551301
  misc_feature: HIJSMM301CVHFX.15.81.H04.1.454.light.4.raw

SEQ ID NO: 585897 - DNA, 521 bp, Homo sapiens
  misc_feature: HIJSMM301B2E52.12.71.G05.1.454.light.4.raw
atacgacgtacacgaccggtgctcgatttagtgtcgtcgcaagagagagggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccgccct

SEQ ID NO: 585898 - DNA, 447 bp, Homo sapiens; identical to SEQ ID NO: 535201
  misc_feature: HIJSMM301EINY4.18.9.A09.1.454.light.4.raw

SEQ ID NO: 585899 - DNA, 485 bp, Homo sapiens; identical to SEQ ID NO: 535985
  misc_feature: HIJSMM301C555R.15.1.A01.1.454.light.4.raw

SEQ ID NO: 585900 - DNA, 482 bp, Homo sapiens; identical to SEQ ID NO: 536622
  misc_feature: HIJSMM301BMHWA.7.85.H08.1.454.light.4.raw

SEQ ID NO: 585901 - DNA, 501 bp, Homo sapiens; identical to SEQ ID NO: 535746
  misc_feature: HIJSMM301AJM8J.18.11.A11.1.454.light.4.raw

SEQ ID NO: 585902 - DNA, 447 bp, Homo sapiens
  misc_feature: HIJSMM301D9Z3C.11.86.H09.1.454.light.4.raw
cgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccaccctcctcgtatctctcg

SEQ ID NO: 585903 - DNA, 490 bp, Homo sapiens; identical to SEQ ID NO: 535064
  misc_feature: HIJSMM301AKPRK.10.72.G06.1.454.light.4.raw

SEQ ID NO: 585904 - DNA, 506 bp, Homo sapiens
  misc_feature: HIJSMM301BUCZF.8.33.C11.1.454.light.4.raw
ctcgcgtgtccacgaccggtgctcgatttagagtgagctcgttgggtttggggggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttcggcccgtgggaccgaaggtggagatcaaacgaactgtggctgcaccatctgtcttc

SEQ ID NO: 585905 - DNA, 506 bp, Homo sapiens
  misc_feature: HIJSMM301AMJ3C.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtggaaatacaaacgaactagtggctgcaccactctgtcttctatcttccccg

SEQ ID NO: 585906 - DNA, 497 bp, Homo sapiens
  misc_feature: HIJSMM301EY9J9.13.38.D05.1.454.light.4.raw
tcacgtactacacgaccggtgctcgatttagtatctgatagttgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggagatcaaacgaaactgt

SEQ ID NO: 585907 - DNA, 483 bp, Homo sapiens
  misc_feature: HIJSMM301EQBHE.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgtaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatcaaacgaactgtggctgcac

SEQ ID NO: 585908 - DNA, 483 bp, Homo sapiens; identical to SEQ ID NO: 535777
  misc_feature: HIJSMM301AMOM7.10.1.A01.1.454.light.4.raw

SEQ ID NO: 585909 - DNA, 441 bp, Homo sapiens; identical to SEQ ID NO: 534971
  misc_feature: HIJSMM301BXB6B.11.3.A03.1.454.light.4.raw

SEQ ID NO: 585910 - DNA, 479 bp, Homo sapiens; identical to SEQ ID NO: 545213
  misc_feature: HIJSMM301EGJR5.40.59.F04.1.454.light.4.raw

SEQ ID NO: 585911 - DNA, 488 bp, Homo sapiens; identical to SEQ ID NO: 539612
  misc_feature: HIJSMM301DKMZS.3.55.E11.1.454.light.4.raw

SEQ ID NO: 585912 - DNA, 486 bp, Homo sapiens; identical to SEQ ID NO: 535043
  misc_feature: HIJSMM301AHMXH.46.35.D02.1.454.light.4.raw

SEQ ID NO: 585913 - DNA, 502 bp, Homo sapiens
  misc_feature: HIJSMM301EHROF.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtactcccagccaggttcagtggcagtgggtctgggacagagttcactctcaccatcagcagcctgcagtctgaagattttgcggtttattactgtcagcagtataataactggcctccacggtactacgttttggccgaggggaccaagctggagatacaaacgaactgtggctgcaccatctgtt

SEQ ID NO: 585914 - DNA, 502 bp, Homo sapiens
  misc_feature: HIJSMM301EI8OU.41.70.G04.1.454.light.4.raw
tctatactatcacgaccggtgctcgatttagtgtagtgtgaagggaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcgggcgggggaccgaagctgaccgtcctaggtcagcccaaggctgcccctcggtcactctcg

SEQ ID NO: 585915 - DNA, 416 bp, Homo sapiens; identical to SEQ ID NO: 536892
  misc_feature: HIJSMM301BMALK.16.46.E02.1.454.light.4.raw

SEQ ID NO: 585916 - DNA, 505 bp, Homo sapiens
  misc_feature: HIJSMM301C5HCH.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagtattttgctagtttattattgtcagcagtaataataactggcctccgtggacgttcggccaagggaccaaggtaggaaatacaaacgaactagtggctgcaccatctgtcttcta

SEQ ID NO: 585917 - DNA, 511 bp, Homo sapiens; identical to SEQ ID NO: 549837
  misc_feature: HIJSMM301BK0P2.15.34.D01.1.454.light.4.raw

SEQ ID NO: 585918 - DNA, 496 bp, Homo sapiens; identical to SEQ ID NO: 551939
  misc_feature: HIJSMM301ANEQL.19.71.G05.1.454.light.4.raw

SEQ ID NO: 585919 - DNA, 486 bp, Homo sapiens; identical to SEQ ID NO: 585198
  misc_feature: HIJSMM301B23T1.47.78.H01.1.454.light.4.raw

SEQ ID NO: 585920 - DNA, 489 bp, Homo sapiens
  misc_feature: HIJSMM301D0DVK.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccagggaccaagctggagatcaaacgaactgtggctgcaccatcttcg

SEQ ID NO: 585921 - DNA, 484 bp, Homo sapiens; identical to SEQ ID NO: 577957
  misc_feature: HIJSMM301CWPZV.49.57.F02.1.454.light.4.raw

SEQ ID NO: 585922 - DNA, 480 bp, Homo sapiens; identical to SEQ ID NO: 535630
  misc_feature: HIJSMM301DYZQO.40.59.F04.1.454.light.4.raw

SEQ ID NO: 585923 - DNA, 483 bp, Homo sapiens
  misc_feature: HIJSMM301AEM9A.52.5.A05.1.454.light.4.raw
cgcagtacgacacgaccggtgctcgatttagatagatagacagggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggtagggaccaagctgaccgtcctacgtcagcccaaggctgccccctc

SEQ ID NO: 585924 - DNA, 483 bp, Homo sapiens; identical to SEQ ID NO: 536691
  misc_feature: HIJSMM301BCU54.17.26.C04.1.454.light.4.raw

SEQ ID NO: 585925 - DNA, 444 bp, Homo sapiens; identical to SEQ ID NO: 534993
  misc_feature: HIJSMM301CGCZ2.5.9.A09.1.454.light.4.raw

SEQ ID NO: 585926 - DNA, 480 bp, Homo sapiens; identical to SEQ ID NO: 535630
  misc_feature: HIJSMM301CU0M0.40.59.F04.1.454.light.4.raw

SEQ ID NO: 585927 - DNA, 499 bp, Homo sapiens; identical to SEQ ID NO: 547044
  misc_feature: HIJSMM301CKHIH.43.71.G05.1.454.light.4.raw

SEQ ID NO: 585928 - DNA, 434 bp, Homo sapiens; identical to SEQ ID NO: 553937
  misc_feature: HIJSMM301BIKGG.10.38.D05.1.454.light.4.raw

SEQ ID NO: 585929 - DNA, 506 bp, Homo sapiens
  misc_feature: HIJSMM301EURLH.53.71.G05.1.454.light.4.raw
cgcgtatacacacgaccggtgctcgatttagtgtcgtcgcaagagagaggggcgtggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctcgccccctcggtcactctgtt

SEQ ID NO: 585930 - DNA, 513 bp, Homo sapiens; identical to SEQ ID NO: 535244
  misc_feature: HIJSMM301DJN1O.17.33.C11.1.454.light.4.raw

SEQ ID NO: 585931 - DNA, 460 bp, Homo sapiens; identical to SEQ ID NO: 537107
  misc_feature: HIJSMM301D26UC.22.28.C06.1.454.light.4.raw

SEQ ID NO: 585932 - DNA, 503 bp, Homo sapiens; identical to SEQ ID NO: 572226
  misc_feature: HIJSMM301C5KMI.22.15.B04.1.454.light.4.raw

SEQ ID NO: 585933 - DNA, 486 bp, Homo sapiens
  misc_feature: HIJSMM301D1GVQ.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggtgtgggacagcagcactgaggtgttcggcggagggaccaagctgaccgtcctacgtcagcccaaggctgccccc

SEQ ID NO: 585934 - DNA, 486 bp, Homo sapiens; identical to SEQ ID NO: 535043
  misc_feature: HIJSMM301EJ5FS.46.35.D02.1.454.light.4.raw

SEQ ID NO: 585935 - DNA, 487 bp, Homo sapiens; identical to SEQ ID NO: 536206
  misc_feature: HIJSMM301B0NZI.47.38.D05.1.454.light.4.raw

SEQ ID NO: 585936 - DNA, 496 bp, Homo sapiens
  misc_feature: HIJSMM301EHO4Z.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaacgactgtggctgcaccatctgtcttcatcttcccgcatctgacc

SEQ ID NO: 585937 - DNA, 463 bp, Homo sapiens
  misc_feature: HIJSMM301BOL73.49.8.A08.1.454.light.4.raw
agtcgagagacacgaccggtgctcgatttagcatactctacaggggaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctccgctcactttcggcggagggaccaaggtggagatcaaacgaa

SEQ ID NO: 585938 - DNA, 484 bp, Homo sapiens
  misc_feature: HIJSMM301ALH2S.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggcagggaccaagctggagatcaaacgaactgtggctgcaccat

SEQ ID NO: 585939 - DNA, 517 bp, Homo sapiens
  misc_feature: HIJSMM301BWF29.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcct

SEQ ID NO: 585940 - DNA, 441 bp, Homo sapiens
  misc_feature: HIJSMM301BTTEB.10.40.D07.1.454.light.4.raw
catagtagtgcacgaccggtgctcgatttagtgatagagcgtaacaacagaggggggggtgagggatgagaacctatgaacattctgtaggggtcaccatctcctgcactgggaacaacttcaacatcggggcagcttacgatgtccactggtatcgccaacttccaggcacagcccccaaaatcgtcttctatggtgacttcaatcggccctcaggggtccctgaccgcttctctggcttcaagtctggcacgtatgacacgtcccatttcctggccatcaatgggctccaggctgaagatgaggctgattactactgccagtcgtatgacaccaagctgaaactttgggtcttcggcggagggaccaggctgaccgtcctacgtcagccaaggctcgccccctcggtcactctcgttcccaccctcctccactactatg

SEQ ID NO: 585941 - DNA, 489 bp, Homo sapiens
  misc_feature: HIJSMM301DH31K.14.36.D03.1.454.light.4.raw
cgtctagtaccacgaccggtgctcgatttagctgcgtcacgatctctcttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggcctcagggtttctaatcgcttctctggctccaagtctggcaacacggcctccctgaccatctctgggctccaggctgaggacgagtctgattattattgcagctcatatgcacctggcagcaatcatgtggttttcggcggggggaccaaggtgaccgtcctaggtcagccc

SEQ ID NO: 585942 - DNA, 512 bp, Homo sapiens
  misc_feature: HIJSMM301DR2OU.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagagatcaaacgaactagtggctgcaccatctgtcttctatcttcccg

SEQ ID NO: 585943 - DNA, 485 bp, Homo sapiens
  misc_feature: HIJSMM301A6PEE.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccagcgttcggccaggggaccaaggtggaagtcaagcgaactgtggctgcaccatct

SEQ ID NO: 585944 - DNA, 522 bp, Homo sapiens
  misc_feature: HIJSMM301BIUAE.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaacggaccgaacggtagggaaagtacaagacgaacgtacgtaggtcgtgtcgaccaactctgtcttctactcttcccgt

SEQ ID NO: 585945 - DNA, 487 bp, Homo sapiens
  misc_feature: HIJSMM301C9E87.49.22.B11.1.454.light.4.raw
agtcgagagacacgaccggtgctcgatttagacgacagctcagggcacgaccggtgctcgatttagtagtgtagattcgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcacttcggtcggagggaccac

SEQ ID NO: 585946 - DNA, 495 bp, Homo sapiens; identical to SEQ ID NO: 535596
  misc_feature: HIJSMM301CTVHM.10.79.H02.1.454.light.4.raw

SEQ ID NO: 585947 - DNA, 496 bp, Homo sapiens
  misc_feature: HIJSMM301EMBE4.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatggttgggctctattattgcatgacaagctctacaacgtcccgctctactttcggcgggacgggaaccgaaggtggagatacgaaacgaacg

SEQ ID NO: 585948 - DNA, 488 bp, Homo sapiens
  misc_feature: HIJSMM301E3H85.40.71.G05.1.454.light.4.raw
tctagcgactcacgaccggtgctcgatttagtgtcgtcgcaagagagaggggcacgaccggtgctcgatttagtgtcgtcgcaagagagagggggaagctctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccgggacagaaggtcaccatctcctgctctggaagcagctccaacattgggaaaaattatgtatcctggtaccagcagctcccaggaacagcccccaaactcctcatttatgacaataataagcgaccctcagggattcctgaccgattctctggctccaagtctggcacgtcagccaccctgggcatcaccggactccagactggcgacgaggccgtttatattgcggaacatgggatagcgg

SEQ ID NO: 585949 - DNA, 506 bp, Homo sapiens; identical to SEQ ID NO: 542696
  misc_feature: HIJSMM301ALGB7.7.71.G05.1.454.light.4.raw

SEQ ID NO: 585950 - DNA, 485 bp, Homo sapiens
  misc_feature: HIJSMM301DANXB.51.40.D07.1.454.light.4.raw
cgatcgtatacacgaccggtgctcgatttagtgatagagcgtaacaacagagggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccagggcaagcccctaaactcctgatctacgatgcatccaatttggaaacaggggtcccatcaaggttcagtgaagtggttctgggacagattttactttcaccatcagcagccttcaccctgaagatcttgcaacatattactgttcaacagtatgatagtctcccgctcactttcggcgggggaccaaggtggagatcaagcgaactgtggctgcaccta

SEQ ID NO: 585951 - DNA, 487 bp, Homo sapiens
  misc_feature: HIJSMM301A202V.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatacaaacgaa

SEQ ID NO: 585952 - DNA, 496 bp, Homo sapiens; identical to SEQ ID NO: 536248
  misc_feature: HIJSMM301EIBJX.22.27.C05.1.454.light.4.raw

SEQ ID NO: 585953 - DNA, 481 bp, Homo sapiens; identical to SEQ ID NO: 559501
  misc_feature: HIJSMM301DVTAN.40.86.H09.1.454.light.4.raw

SEQ ID NO: 585954 - DNA, 517 bp, Homo sapiens
  misc_feature: HIJSMM301BH4H2.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggaccagaccctggagcctcagttggaagcagccgatccagcctgcggagctggtgggcaggtcagcccaaggcccaacccactcgtcactctccg

SEQ ID NO: 585955 - DNA, 502 bp, Homo sapiens; identical to SEQ ID NO: 541971
  misc_feature: HIJSMM301B91K2.4.39.D06.1.454.light.4.raw

SEQ ID NO: 585956 - DNA, 492 bp, Homo sapiens; identical to SEQ ID NO: 537395
  misc_feature: HIJSMM301BMX1R.16.73.G07.1.454.light.4.raw

SEQ ID NO: 585957 - DNA, 448 bp, Homo sapiens; identical to SEQ ID NO: 538166
  misc_feature: HIJSMM301A2GYD.18.9.A09.1.454.light.4.raw

SEQ ID NO: 585958 - DNA, 445 bp, Homo sapiens
  misc_feature: HIJSMM301BPCZE.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcccagtcctatgacatgaggctgagtggttcgtatgtcttcggatctgggaccaaggtcaccgtcctaagtcagccaaggccaaccctctgtcactctgttcccaccctcctccatatcgta

SEQ ID NO: 585959 - DNA, 504 bp, Homo sapiens
  misc_feature: HIJSMM301EZFNM.29.67.G01.1.454.light.4.raw
atagagtactcacgaccggtgctcgatttagagtatacatattgggtttgggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaaatttttgtgcagtggtaccagcagcgcccgggcagttcccccaccattgtgatctatgaggataatcaaagaccgtctggggtccctgatcggttctctggctccatcgacagctcctccaactctgcctccctcaccatctctggactgaagactgaggacgaggctgactactactgttcagtcttatgatagccgcggtcatgtggtcttcggcggagggaccaagctgaccgtcctaggtcagcccaaggctgccccctc

SEQ ID NO: 585960 - DNA, 504 bp, Homo sapiens
  misc_feature: HIJSMM301BJMXM.48.25.C03.1.454.light.4.raw
agtatacatacacgaccggtgctcgatttagtagtgtagatttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaagggtggacatcaaacgaactgtggctgcaccatctgtcttcatcttcccg

SEQ ID NO: 585961 - DNA, 404 bp, Homo sapiens; identical to SEQ ID NO: 535779
  misc_feature: HIJSMM301A14T3.4.35.D02.1.454.light.4.raw

SEQ ID NO: 585962 - DNA, 493 bp, Homo sapiens
  misc_feature: HIJSMM301EH8VZ.5.40.D07.1.454.light.4.raw
  modified_base (479)..(479): a, c, t, g, unknown or other
atcagacacgcacgaccggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaagagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcaacagtataatgactggtggacgttcggccaagggaccgaaggtgggagaaccaaacgaacgtgtggngtgcaccatctgtt

SEQ ID NO: 585963 - DNA, 489 bp, Homo sapiens
  misc_feature: HIJSMM301EF3L0.48.29.C07.1.454.light.4.raw
agtatacatacacgaccggtgctcgatttagagtgctacgaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgccccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 585964 - DNA, 497 bp, Homo sapiens; identical to SEQ ID NO: 538296
  misc_feature: HIJSMM301AONAX.18.11.A11.1.454.light.4.raw

SEQ ID NO: 585965 - DNA, 484 bp, Homo sapiens; identical to SEQ ID NO: 535400
  misc_feature: HIJSMM301BF0IH.46.26.C04.1.454.light.4.raw

SEQ ID NO: 585966 - DNA, 477 bp, Homo sapiens
  misc_feature: HIJSMM301BA21A.49.82.H05.1.454.light.4.raw
agtcgagagacacgaccggtgctcgatttagtcgagctctctcgcgggcacgaccggtgctcgatttagacgcgatcgaagggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttaggagcaacttagcctggtatcagcagaaacctggccaggctcccaggctcctcatctatggtgcatccaccagggccactggtatcccagccaggttcagtggcagtgggtctgggacagagttcactctcaccatcagcagcctgcagtctgaagatgtggcagtgtattactgtcagcaatatcacactgctccgctcactttc

SEQ ID NO: 585967 - DNA, 471 bp, Homo sapiens; identical to SEQ ID NO: 537461
  misc_feature: HIJSMM301D6O0G.7.81.H04.1.454.light.4.raw

SEQ ID NO: 585968 - DNA, 401 bp, Homo sapiens
  misc_feature: HIJSMM301B0AUP.8.53.E09.1.454.light.4.raw
ctcgcgtgtccacgaccggtgctcgatttagagagagtgtgttgggtttggggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccaccctcctcgacacgcgag

SEQ ID NO: 585969 - DNA, 503 bp, Homo sapiens; identical to SEQ ID NO: 546938
  misc_feature: HIJSMM301C7QUA.12.37.D04.1.454.light.4.raw

SEQ ID NO: 585970 - DNA, 506 bp, Homo sapiens
  misc_feature: HIJSMM301B96JZ.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcggtggcagtgggtctgggacagacttcactctcaccatcatcagcctggagcctgaagatgttgcagtttattactgtcaacatcgtaccgagtggcctccgggggccactttcggccctgggaccaagtggatatcaaacgaactagtggctgcaccatctgtctt

SEQ ID NO: 585971 - DNA, 484 bp, Homo sapiens; identical to SEQ ID NO: 535400
  misc_feature: HIJSMM301CO198.46.26.C04.1.454.light.4.raw

SEQ ID NO: 585972 - DNA, 488 bp, Homo sapiens
  misc_feature: HIJSMM301D5YIA.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaggtggagtatcagacgaa

SEQ ID NO: 585973 - DNA, 487 bp, Homo sapiens; identical to SEQ ID NO: 558047
  misc_feature: HIJSMM301CXQ41.4.26.C04.1.454.light.4.raw

SEQ ID NO: 585974 - DNA, 488 bp, Homo sapiens
  misc_feature: HIJSMM301DT1A6.4.64.F09.1.454.light.4.raw
agcactgtagcacgaccggtgctcgatttagcgcgtatacaagggggagtcagacccagtcaggacacagcgtggacatgagggtccccgctcagctcctggggctcctgctgctctggttcccaggttccagatgcgacatccagatgacccagtctccatcttccgtgtctgcatctgtgggcgacagagtcaccatcacttgtcgggcgagtcaggacattgggacccgattagcctggtatcagcagaaaccagggaaagcccctaacctcctcatctatgctgcgtccagtttgcacagtggggtcccattgaggttcagcggcagtggttctgagacagatttcagtctcaccatccgtgacctgcagcctgaagattttgctaacttacttttgtcaacagactaactcattccctcgcagtttggccaggggaccaaggtggagatcaaacgaactgtggctgcaccatctgtcttcatt

SEQ ID NO: 585975 - DNA, 462 bp, Homo sapiens; identical to SEQ ID NO: 569799
  misc_feature: HIJSMM301B8WSQ.11.73.G07.1.454.light.4.raw

SEQ ID NO: 585976 - DNA, 494 bp, Homo sapiens
  misc_feature: HIJSMM301AU702.26.12.B01.1.454.light.4.raw
  modified_base (478)..(478): a, c, t, g, unknown or other
agactatactcacgaccggtgctcgatttagtagtgtagatcccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcgggggaccaagctggagatcaaccgaactntggctgcaccatctgt

SEQ ID NO: 585977 - DNA, 499 bp, Homo sapiens
  misc_feature: HIJSMM301CZN70.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccggggccactttcggccctgggaccaagtggatatcaaacgaactgtggctgcaccatctgtcttcat

SEQ ID NO: 585978 - DNA, 509 bp, Homo sapiens; identical to SEQ ID NO: 539269
  misc_feature: HIJSMM301DTJ37.4.57.F02.1.454.light.4.raw

SEQ ID NO: 585979 - DNA, 493 bp, Homo sapiens
  misc_feature: HIJSMM301DU9PP.10.33.C11.1.454.light.4.raw
catagtagtgcacgaccggtgctcgatttagagtgagctcgttgggtttggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtcccgctcactttcggcggagggaccaaaatagaggtcaaacgaactgtggctgcaccatctgtcttcta

SEQ ID NO: 585980 - DNA, 489 bp, Homo sapiens; identical to SEQ ID NO: 540247
  misc_feature: HIJSMM301B918O.48.75.G09.1.454.light.4.raw

SEQ ID NO: 585981 - DNA, 510 bp, Homo sapiens
  misc_feature: HIJSMM301BEULC.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctcgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctgcccccc

SEQ ID NO: 585982 - DNA, 487 bp, Homo sapiens
  misc_feature: HIJSMM301D8JU1.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatctaccactcactttcggcggagggaccacggtggaggatcaaacgaactgtggctgcaccaatctgtcttcta

SEQ ID NO: 585983 - DNA, 492 bp, Homo sapiens; identical to SEQ ID NO: 539815
  misc_feature: HIJSMM301DTJ8F.51.81.H04.1.454.light.4.raw

SEQ ID NO: 585984 - DNA, 507 bp, Homo sapiens; identical to SEQ ID NO: 567918
  misc_feature: HIJSMM301AUSUP.4.10.A10.1.454.light.4.raw

SEQ ID NO: 585985 - DNA, 477 bp, Homo sapiens; identical to SEQ ID NO: 535122
  misc_feature: HIJSMM301CXU87.26.72.G06.1.454.light.4.raw

SEQ ID NO: 585986 - DNA, 486 bp, Homo sapiens; identical to SEQ ID NO: 535290
  misc_feature: HIJSMM301ANXP9.3.12.B01.1.454.light.4.raw

SEQ ID NO: 585987 - DNA, 498 bp, Homo sapiens; identical to SEQ ID NO: 553247
  misc_feature: HIJSMM301AZMFJ.40.57.F02.1.454.light.4.raw

SEQ ID NO: 585988 - DNA, 476 bp, Homo sapiens
  misc_feature: HIJSMM301ENARF.52.19.B08.1.454.light.4.raw
cgcagtacgacacgaccggtgctcgatttagtgagtcagtaagggggagtcagtcccaaccaggacacagcatggacatgagggtccctgctcagctcctggggctcctgctgctctggctctcaggtgtcagatgtgtcatccagatgacccagtctccttcctccctgtctgcatctataggagacagaatcaccatcacttgccgggcgagtcgagacattagcatgtatctgaattggtatcagcaaaaagtagggacagcccctaaactcctgatcctcgatgcatccactttggagacaggggtcccatcaaggttcagtggaagtggctctgggacagattttactttcaccatcagcaggctgcagcctgaagatgttgcaacatattactgtcaacagtataatcgtctcccgctcactttcggcgggggaccaaggtggagatcaagcgaactgtggctgcaccta

SEQ ID NO: 585989 - DNA, 486 bp, Homo sapiens; identical to SEQ ID NO: 535043
  misc_feature: HIJSMM301AKEHM.46.35.D02.1.454.light.4.raw

SEQ ID NO: 585990 - DNA, 511 bp, Homo sapiens; identical to SEQ ID NO: 548439
  misc_feature: HIJSMM301ALN0H.16.46.E02.1.454.light.4.raw

SEQ ID NO: 585991 - DNA, 512 bp, Homo sapiens
  misc_feature: HIJSMM301EG7LY.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtcctaggtcagcccaaggctgccccctcggtcactctgtt

SEQ ID NO: 585992 - DNA, 514 bp, Homo sapiens; identical to SEQ ID NO: 539814
  misc_feature: HIJSMM301C7TH9.16.88.H11.1.454.light.4.raw

SEQ ID NO: 585993 - DNA, 508 bp, Homo sapiens; identical to SEQ ID NO: 552440
  misc_feature: HIJSMM301BDS90.5.24.C02.1.454.light.4.raw

SEQ ID NO: 585994 - DNA, 517 bp, Homo sapiens
  misc_feature: HIJSMM301AMXLP.48.17.B06.1.454.light.4.raw
agtatacatacacgaccggtgctcgatttagtcgatagtgaagggggggtcacaagaggcagcgctctcgggacgtctccaccatggcctgggctctgctgctcctcaccctcctcactcaggacacagggtcctgggcccaggctgccctgactcagccagcctccgtgtctgcctctcctggacagtcggtcaatctttcctgcactggaaccgcctatgacattggaaaatataaccttgtctcctggtaccagcaacacccaggcaaagcccccaaattaattatttatacggtcaataagagaccgtcaggggtctctgctcgcttctctgggtccaagtctggcgacacggcctccctcacaatctctgggctccaggctgacgacgaggcttcctattgctgctcctcatatgtaggatccggctcttatctgattttcggcggagggaccaagctgaccgtcctacgtcagcccaaggctgccccctcggtccactctgttcccgccct

SEQ ID NO: 585995 - DNA, 489 bp, Homo sapiens; identical to SEQ ID NO: 543840
  misc_feature: HIJSMM301BMTAK.12.88.H11.1.454.light.4.raw

SEQ ID NO: 585996 - DNA, 473 bp, Homo sapiens; identical to SEQ ID NO: 535262
  misc_feature: HIJSMM301BW5HW.8.67.G01.1.454.light.4.raw

SEQ ID NO: 585997 - DNA, 445 bp, Homo sapiens; identical to SEQ ID NO: 555301
  misc_feature: HIJSMM301A6OUJ.5.9.A09.1.454.light.4.raw

SEQ ID NO: 585998 - DNA, 486 bp, Homo sapiens; identical to SEQ ID NO: 535043
  misc_feature: HIJSMM301ENSAO.46.35.D02.1.454.light.4.raw

SEQ ID NO: 585999 - DNA, 523 bp, Homo sapiens
  misc_feature: HIJSMM301CYHBG.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaattggcccccaggggtttctgatcgcttctatggctccaagtctgcctacacggcctccctgaccatctccgggctccagcctgaggacgaggctgattattattgtagttcattatacaaccagtgacacttgggtgttcggcgggagggaccaggctgaccgtcccgtaggtcagcccaaggctcgccccctcggtcactcttccgtccc

SEQ ID NO: 586000 - DNA, 520 bp, Homo sapiens
  misc_feature: HIJSMM301B8ZVG.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaaacagagttacccttctccccccggacgttcggtccaacgggaccgaacggtagggtaaagtacaagacgaactacgtggcgtgcgaccatctgtcttcactcttcccgt

SEQ ID NO: 586001 - DNA, 484 bp, Homo sapiens; identical to SEQ ID NO: 535400
  misc_feature: HIJSMM301C49CK.46.26.C04.1.454.light.4.raw

SEQ ID NO: 586002 - DNA, 520 bp, Homo sapiens; identical to SEQ ID NO: 562605
  misc_feature: HIJSMM301C52BY.27.23.C01.1.454.light.4.raw
  modified_base (517)..(517): a, c, t, g, unknown or other

SEQ ID NO: 586003 - DNA, 489 bp, Homo sapiens
  misc_feature: HIJSMM301AO8TK.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcaccc

SEQ ID NO: 586004 - DNA, 497 bp, Homo sapiens; identical to SEQ ID NO: 536371
  misc_feature: HIJSMM301B7O2O.16.78.H01.1.454.light.4.raw

SEQ ID NO: 586005 - DNA, 516 bp, Homo sapiens; identical to SEQ ID NO: 582724
  misc_feature: HIJSMM301EWHFB.12.85.H08.1.454.light.4.raw

SEQ ID NO: 586006 - DNA, 489 bp, Homo sapiens; identical to SEQ ID NO: 545019
  misc_feature: HIJSMM301EM7XT.19.57.F02.1.454.light.4.raw

SEQ ID NO: 586007 - DNA, 496 bp, Homo sapiens
  misc_feature: HIJSMM301CFFNU.21.27.C05.1.454.light.4.raw
tcgtcgctcgcacgaccggtgctcgatttagacgcgatcgaagggtttggggggaactgctcagttaggacccagacggagccatggaagccccagcgcagcttctcttcctcctgcttctctggctcccagacaccactggagtgattgtgatgacgcagtctccagccaccctgtctgtgtctccaggggggagcgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgcagtttatttctgccagcaatataattactggcctgcgtcgacgttcggccacgggaccaaggtggaaatcaaacgaactgtggctgcaccatctgtcttcta

SEQ ID NO: 586008 - DNA, 486 bp, Homo sapiens; identical to SEQ ID NO: 535385
  misc_feature: HIJSMM301DRSIS.19.71.G05.1.454.light.4.raw

SEQ ID NO: 586009 - DNA, 520 bp, Homo sapiens
  misc_feature: HIJSMM301BTGOH.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacactgggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttgggtgttcggcggcgggaccaaagtgaccgtcctaagtcagcccaaggctgccccctcggtcactctgttcccaccct

SEQ ID NO: 586010 - DNA, 492 bp, Homo sapiens; identical to SEQ ID NO: 535126
  misc_feature: HIJSMM301EHUDZ.18.11.A11.1.454.light.4.raw

SEQ ID NO: 586011 - DNA, 485 bp, Homo sapiens; identical to SEQ ID NO: 535501
  misc_feature: HIJSMM301A1VKJ.3.10.A10.1.454.light.4.raw

SEQ ID NO: 586012 - DNA, 483 bp, Homo sapiens; identical to SEQ ID NO: 536691
  misc_feature: HIJSMM301A1F4G.17.26.C04.1.454.light.4.raw

SEQ ID NO: 586013 - DNA, 499 bp, Homo sapiens; identical to SEQ ID NO: 575204
  misc_feature: HIJSMM301ATY15.5.24.C02.1.454.light.4.raw

SEQ ID NO: 586014 - DNA, 447 bp, Homo sapiens
  misc_feature: HIJSMM301CBIED.11.86.H09.1.454.light.4.raw
cgagagataccacgaccggtgctcgatttagtgctatagacttgggtcctgggcccagtctgtgctgactcagccaccctcagcgtctgggacccccgggcagagggtcatcatctcttgttctggaagcagctctaatatcggaagtaatactgtaaattggtatcaacaactcccaggaacggccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactctgttcccgccctcctcgtatctctcg

SEQ ID NO: 586015 - DNA, 476 bp, Homo sapiens
  misc_feature: HIJSMM301A8AOZ.51.67.G01.1.454.light.4.raw
cgatcgtatacacgaccggtgctcgatttagagtatacatattgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagatttttactttcaccatcagcaggctgcagcctgaagacattgcaacatattactgtcaacagtatgatagtctcccgctcactttcggcgggggaccgaaggtggagatcaagcgaactgtggctgca

SEQ ID NO: 586016 - DNA, 500 bp, Homo sapiens; identical to SEQ ID NO: 546613
  misc_feature: HIJSMM301B6G08.11.21.B10.1.454.light.4.raw

SEQ ID NO: 586017 - DNA, 498 bp, Homo sapiens
  misc_feature: HIJSMM301AJE2L.9.53.E09.1.454.light.4.raw
tgatacgtctcacgaccggtgctcgatttagagagagtgtgttgggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgatttattactgctgctcatatgcagatggtgacactcccgtggtattcggcggagggaccaaggtgaccgtcctaggtcagccaaggctcgccccctc

SEQ ID NO: 586018 - DNA, 506 bp, Homo sapiens
  misc_feature: HIJSMM301A5TW2.14.57.F02.1.454.light.4.raw
cgtctagtaccacgaccggtgctcgatttagctcgatatagttgggtttgggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgctagtttattactgtcagcagcgggcaattggccgctcactttcggcggggggaccaagggtggagttcaaacgaactgtggctgcaccatctgtcttcactcttcccgccta

SEQ ID NO: 586019 - DNA, 505 bp, Homo sapiens
  misc_feature: HIJSMM301AMC9B.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaaggaccgaacggtaggaaagtcaaacgaactagtggctgcaccatctgtcttcatcttccccg

SEQ ID NO: 586020 - DNA, 515 bp, Homo sapiens
  misc_feature: HIJSMM301B9BEP.43.23.C01.1.454.light.4.raw
tgtgagtagtcacgaccggtgctcgatttagtacacgtgattagggattgggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctca

SEQ ID NO: 586021 - DNA, 479 bp, Homo sapiens; identical to SEQ ID NO: 537235
  misc_feature: HIJSMM301DBSSK.22.59.F04.1.454.light.4.raw

SEQ ID NO: 586022 - DNA, 499 bp, Homo sapiens; identical to SEQ ID NO: 557364
  misc_feature: HIJSMM301ET5DT.40.57.F02.1.454.light.4.raw

SEQ ID NO: 586023 - DNA, 487 bp, Homo sapiens; identical to SEQ ID NO: 536206
  misc_feature: HIJSMM301D5GWG.47.38.D05.1.454.light.4.raw

SEQ ID NO: 586024 - DNA, 494 bp, Homo sapiens; identical to SEQ ID NO: 535276
  misc_feature: HIJSMM301E2QLG.16.6.A06.1.454.light.4.raw

SEQ ID NO: 586025 - DNA, 420 bp, Homo sapiens
  misc_feature: HIJSMM301BCC69.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtctaagtcagcccaaggccaaccctctgtcactctgttcccaccctcctccatactcgta

SEQ ID NO: 586026 - DNA, 515 bp, Homo sapiens; identical to SEQ ID NO: 568508
  misc_feature: HIJSMM301EPBLT.17.33.C11.1.454.light.4.raw

SEQ ID NO: 586027 - DNA, 488 bp, Homo sapiens
  misc_feature: HIJSMM301AI39M.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattattacttcgtggacgttcggccaagggaccaaggtggatatcagacgaa

SEQ ID NO: 586028 - DNA, 520 bp, Homo sapiens; identical to SEQ ID NO: 543998
  misc_feature: HIJSMM301AH7ID.27.23.C01.1.454.light.4.raw

SEQ ID NO: 586029 - DNA, 489 bp, Homo sapiens; identical to SEQ ID NO: 547483
  misc_feature: HIJSMM301AXVWH.51.36.D03.1.454.light.4.raw

SEQ ID NO: 586030 - DNA, 520 bp, Homo sapiens
  misc_feature: HIJSMM301AR2LF.49.73.G07.1.454.light.4.raw
agtcgagagacacgaccggtgctcgatttagctctacgctcagggcacgaccggtgctcgatttagtagcatactgttgggtttgggggtgggctcaggaggcagagctctgggaatctcaccatggcctggacccctctcctgcctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagccggggcccaggtggaggatgaaggtgactactattgttactcaccagacaccagtagaaaatcaacagaggaatattcggcggagggaccaagctgaccgtccgtaggtcacg

SEQ ID NO: 586031 - DNA, 486 bp, Homo sapiens
  misc_feature: HIJSMM301BNWQL.3.10.A10.1.454.light.4.raw
agacgcactccacgaccggtgctcgatttagcgtcgatctcagggggctgtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccaggggtcaccgtcctaggtcagcccaaggccaa

SEQ ID NO: 586032 - DNA, 496 bp, Homo sapiens
  misc_feature: HIJSMM301CFOCA.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccaagggaccgaacggtggaagtacaaacgaactagtggcgtgcaccatctgtctt

SEQ ID NO: 586033 - DNA, 494 bp, Homo sapiens; identical to SEQ ID NO: 540110
  misc_feature: HIJSMM301C67HB.51.71.G05.1.454.light.4.raw

SEQ ID NO: 586034 - DNA, 503 bp, Homo sapiens
  misc_feature: HIJSMM301DL1DU.19.71.G05.1.454.light.4.raw
tactctcgtgcacgaccggtgctcgatttagtgtcgtcgcaagagagaggggggtgaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccgaaaggtgggataatcagacgaacctagtggcgt

SEQ ID NO: 586035 - DNA, 506 bp, Homo sapiens
  misc_feature: HIJSMM301EBLZS.51.1.A01.1.454.light.4.raw
cgatcgtatacacgaccggtgctcgatttagacgtctcatcaaaaggaagggggctctgcttcagctgtgagcgcagaaggcaggactcgggacaatcttcatcatgacctgctcccctctcctcctcacccttctcattcactgcacagggtcttgggcccagtctgtgttggcgcagccgccctcagtgtctgcggccccaggacagaaagtcaccatctcctgctctggaaccacctccaacattgggaagaattatgtgtcgtggtaccagcagttcccaggaacggcccccagactcctcattcatgacaataacaaacgagtcccagagatccctgaccgattctctggctccaagtctggcacctcagccaccctggccatcaccggactccagcctggggacgaggccgattattactgcggaacatgggattccagcctgagtggtgtcagggtgttcggcggcgggaccaagctgaccgtcctgagtcagaccccg

SEQ ID NO: 586036 - DNA, 479 bp, Homo sapiens; identical to SEQ ID NO: 535118
  misc_feature: HIJSMM301CHUNM.13.59.F04.1.454.light.4.raw

SEQ ID NO: 586037 - DNA, 486 bp, Homo sapiens
  misc_feature: HIJSMM301EKHNR.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatattattctccagcgttcggccaggggaccaaggtggaagtcaagcgaactgtggctgcacatctgt

SEQ ID NO: 586038 - DNA, 500 bp, Homo sapiens
  misc_feature: HIJSMM301APBM1.4.3.A03.1.454.light.4.raw
agcactgtagcacgaccggtgctcgatttagagagcgtcacgaggggggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagagccaccctctcctgccgggccagtgagagtcttagcggcgactacttagcctggtaccagcaaaaacctggccagtctcccaggctcctcatctctggtgtatccttcagggccactggcatcccagacagattcaggggcagtgggtctgggacagacttcactctcaccatcagcagactggagcctgaagactttgcgctgtatttctgtcagcagtatgttttcgcacctttcactttcggcggtagggaccgaaggtgggagaaacaaacgaaactggtggctgcaccatctgtcttc

SEQ ID NO: 586039 - DNA, 447 bp, Homo sapiens
  misc_feature: HIJSMM301CNRLB.18.9.A09.1.454.light.4.raw
tacgagtatgcacgaccggtgctcgatttagcgagacgcgcagggtcctgggcccagtctgtgctgacgcagccgccctcagtgtctggggccccggggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggcccatcactgggctccaggctgaggatgaggctgactattactgccagtcctatgacatgaggctgagtggttcgtatgtcttcggatctgggaccaaggtcaccgtcctaagtcagcccaaggccaaccctctgtcactctgttcccgccctcctccatactcgta

SEQ ID NO: 586040 - DNA, 510 bp, Homo sapiens; identical to SEQ ID NO: 535376
  misc_feature: HIJSMM301AS57R.17.33.C11.1.454.light.4.raw

SEQ ID NO: 586041 - DNA, 475 bp, Homo sapiens
  misc_feature: HIJSMM301AFF5G.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagattttgcagtttattactgtcagcaatataacaagtggccattcactttcggcccagggaccaaagtaggatatcaaacgaactagtggctgcaccatctgtcttcatcttcccgccact

SEQ ID NO: 586042 - DNA, 503 bp, Homo sapiens; identical to SEQ ID NO: 535044
  misc_feature: HIJSMM301DDPE5.19.78.H01.1.454.light.4.raw

SEQ ID NO: 586043 - DNA, 477 bp, Homo sapiens
  misc_feature: HIJSMM301EKW80.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgaagagaactgtggctgcaa

SEQ ID NO: 586044 - DNA, 489 bp, Homo sapiens; identical to SEQ ID NO: 540424
  misc_feature: HIJSMM301DBU0Y.17.25.C03.1.454.light.4.raw

SEQ ID NO: 586045 - DNA, 500 bp, Homo sapiens; identical to SEQ ID NO: 539563
  misc_feature: HIJSMM301ET72J.8.2.A02.1.454.light.4.raw

SEQ ID NO: 586046 - DNA, 494 bp, Homo sapiens; identical to SEQ ID NO: 534992
  misc_feature: HIJSMM301BV5YO.9.1.A01.1.454.light.4.raw

SEQ ID NO: 586047 - DNA, 500 bp, Homo sapiens
  misc_feature: HIJSMM301D0OI1.13.11.A11.1.454.light.4.raw
tcacgtactacacgaccggtgctcgatttagctacgactgcagggggtaagaggttgtgtccaccatggcctggactcctctcctcctcctgctcctctctcactgcacaggttccctctcgcaggctgtgctgactcagccgtcttccctctctgcttctcctggagcgtcagccagtctcacctgcaccttgcgcagtggcaccaatgttggtccctatgacatatattggtaccgacagaagccagggagtcctccccagtttctcctgaggttcaggtcaaactcagataaacgacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggccaacccactgtcactctcg

SEQ ID NO: 586048 - DNA, 485 bp, Homo sapiens; identical to SEQ ID NO: 535880
  misc_feature: HIJSMM301D3DRM.7.75.G09.1.454.light.4.raw

SEQ ID NO: 586049 - DNA, 478 bp, Homo sapiens
  misc_feature: HIJSMM301CT9N1.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattattattgccagtcctatgacacaccctgcgtggttttgctgtcggcggcgggacc

SEQ ID NO: 586050 - DNA, 505 bp, Homo sapiens; identical to SEQ ID NO: 574205
  misc_feature: HIJSMM301D6OJ6.10.88.H11.1.454.light.4.raw

SEQ ID NO: 586051 - DNA, 506 bp, Homo sapiens; identical to SEQ ID NO: 563474
  misc_feature: HIJSMM301DSCCX.10.27.C05.1.454.light.4.raw

SEQ ID NO: 586052 - DNA, 502 bp, Homo sapiens
  misc_feature: HIJSMM301DQRDW.11.12.B01.1.454.light.4.raw
cgagagataccacgaccggtgctcgatttagtagtgtagattccgcggggctgggcctcaggaggcagcatcggaggtgcctcagccatggcatggatccctctcttcctcggcgtccttgcttactgcacagaatccatggcctcctatgagttgactcagccaccctccatgtccgtgtcccccggacagacagccaccatcagctgctctggagatgtcttgactaatgagtatgcttcctggtatcagcagaaggcaggccagccccctgtcctactcatctttcaaaataccaggcggccctctggggtccctgagcgattctccggctccggctctgggaacacagtcactctgaccatcagcgggacccaggctattgatgaggctgtctacttctgtcaggcggtgggacgaacagcgtggtggttcggcggagggaccgacgtctgaccgtcttaggtcgagcccaacggcgtcgccccctccggtcacctcc

SEQ ID NO: 586053 - DNA, 497 bp, Homo sapiens; identical to SEQ ID NO: 535886
  misc_feature: HIJSMM301D7YW0.8.10.A10.1.454.light.4.raw

SEQ ID NO: 586054 - DNA, 502 bp, Homo sapiens
  misc_feature: HIJSMM301CDV7E.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtggagatcaaacgaactgtggctgcaccatctgtcttcattctcccgccatcctgaccta

SEQ ID NO: 586055 - DNA, 496 bp, Homo sapiens
  misc_feature: HIJSMM301D9NRZ.43.4.A04.1.454.light.4.raw
tgtgagtagtcacgaccggtgctcgatttagagtagtgatcagggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccg

SEQ ID NO: 586056 - DNA, 493 bp, Homo sapiens; identical to SEQ ID NO: 538304
  misc_feature: HIJSMM301A3PQ7.26.72.G06.1.454.light.4.raw

SEQ ID NO: 586057 - DNA, 478 bp, Homo sapiens
  misc_feature: HIJSMM301DHQJH.52.1.A01.1.454.light.4.raw
cgcagtacgacacgaccggtgctcgatttagacgtctcatcagggggcaggagtcagtctcagtcaggacacagcatggacatgagggtccccgctcagctcctggggctcctgctactctggctccgaggtgccagatgtgtcatccagatgacccagtctccatcctccctgtccgcatctgtaggagacagagtcatcatcacttgccgggcaagtcagagcattagaacgtatttaaattggtatcaacagaaaccagggaaagcccctgaactcctgatctatggttcatccactttgctgagtggggtcccatcaaggttcagtggcagtggatctgggacagaattcactctcaccatcaccagtctgcaggctgaggattttgcaacttacttctgtcaacagagttacagttccctcactttcggccctcggaccgatagtggatatcaaacgaaactgtggctgcacc

SEQ ID NO: 586058 - DNA, 510 bp, Homo sapiens; identical to SEQ ID NO: 537801
  misc_feature: HIJSMM301BLDIO.5.60.F05.1.454.light.4.raw

SEQ ID NO: 586059 - DNA, 486 bp, Homo sapiens
  misc_feature: HIJSMM301DR3TP.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcatcat

SEQ ID NO: 586060 - DNA, 488 bp, Homo sapiens; identical to SEQ ID NO: 545628
  misc_feature: HIJSMM301DFZYU.14.55.E11.1.454.light.4.raw

SEQ ID NO: 586061 - DNA, 504 bp, Homo sapiens; identical to SEQ ID NO: 542411
  misc_feature: HIJSMM301EFXOM.9.53.E09.1.454.light.4.raw

SEQ ID NO: 586062 - DNA, 514 bp, Homo sapiens
  misc_feature: HIJSMM301C5OH0.8.43.D10.1.454.light.4.raw
ctcgcgtgtccacgaccggtgctcgatttagactagcagtaaggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccagcactggagcagtcaccagtggttactatccaaactggttccagcagaaacctggacaagcacccaggccactgatttatagtacaaacaacagacactcctggacccctgcccggttctcaggctccctccttggggccaaagctgccctgacactgtcaggtgtgcagcctgaggacgaggctgagtattactgcctgctctattatggtgggccttgggtgttcggcggagggaccaagctgaccgtctaggtcagcccaaggctgccccctcggtcactctgttcccacctcctcgacacgcg

SEQ ID NO: 586063 - DNA, 508 bp, Homo sapiens
  misc_feature: HIJSMM301A5EQG.47.55.E11.1.454.light.4.raw
  modified_base (200)..(200): a, c, t, g, unknown or other
agctcacgtacacgaccggtgctcgatttagcactcgcacgttgggtttgggagcttcagctgtggtagagaagacaggattcaggacaatctccagcatggccggcttccctctcctcctcaccctcctcactcactgtgcagggtcttgggcccagtctgtgctgactcagccaccctcagcgtctgggacccccggnagacggtcaccatctcttgttctggaagcagctccaaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtggctccggcccgaggatgaggctgattattactgtgtaggttgggatcgcagcctgactgcttacgtcttcggagctgggaccaaggtcaccgtacctaggtcagcccaaggccaaccccta

SEQ ID NO: 586064 - DNA, 514 bp, Homo sapiens
  misc_feature: HIJSMM301DU1L7.16.85.H08.1.454.light.4.raw
tgtactactccacgaccggtgctcgatttagtatcactcagtcgcggggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgtttggtcgtctatgatgataccgagcggccctcagggatccctgagcgattctccggctccaactctggtgacacggccaccctgacccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgtcccgccctcctcg

SEQ ID NO: 586065 - DNA, 492 bp, Homo sapiens; identical to SEQ ID NO: 536010
  misc_feature: HIJSMM301BILL3.10.20.B09.1.454.light.4.raw

SEQ ID NO: 586066 - DNA, 465 bp, Homo sapiens; identical to SEQ ID NO: 540896
  misc_feature: HIJSMM301CMYS4.11.70.G04.1.454.light.4.raw

SEQ ID NO: 586067 - DNA, 490 bp, Homo sapiens
  misc_feature: HIJSMM301BF7L0.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcacgtttcggcggagggaccaaggttgagatcaaacgaactgtggctgcaccta

SEQ ID NO: 586068 - DNA, 497 bp, Homo sapiens
  misc_feature: HIJSMM301ERBAE.51.83.H06.1.454.light.4.raw
  modified_base (378)..(378): a, c, t, g, unknown or other
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagngcctgaagattttgcagtttatattgtcagcagcgaaacaactggcctccttggacgttcggccaaggaccgaaggtggaaatacaaacgaaactgtggctgcaccatctgtcttcatt

SEQ ID NO: 586069 - DNA, 480 bp, Homo sapiens
  misc_feature: HIJSMM301EXA5P.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgtcatgcaagcaacacactggccgtacacttttggccaggggaccaagctggagatcaatcgaa

SEQ ID NO: 586070 - DNA, 483 bp, Homo sapiens; identical to SEQ ID NO: 537371
  misc_feature: HIJSMM301BMQC2.13.55.E11.1.454.light.4.raw

SEQ ID NO: 586071 - DNA, 520 bp, Homo sapiens; identical to SEQ ID NO: 539176
  misc_feature: HIJSMM301B52K2.27.23.C01.1.454.light.4.raw

SEQ ID NO: 586072 - DNA, 503 bp, Homo sapiens
  misc_feature: HIJSMM301CSTFG.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaatcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccact

SEQ ID NO: 586073 - DNA, 512 bp, Homo sapiens
  misc_feature: HIJSMM301EL155.14.7.A07.1.454.light.4.raw
cgtctagtaccacgaccggtgctcgatttagcacgtgtcgcagggggccctgaggaaaacaaaccccagctgggaagcctgagaacacttagccttcatgagtgtccccaccatggcctgcatgatgcttctcctcggactccttgcttatggatcaggagtggtttctcagactgtggtgacccaggaaccatcgttctcagtgtcccctggagagacaatcacactcacttgtggcttagactctggctcagtctccaccgctcattatcccagctggtaccggcagaccccaggccaggctccacggctcctcatttacagcacaaagaatcggtctttggggtccctgatcgcttctctggctccatccttgggaacaaggctgccctcaccatcacgggggcccaggcagatgatgaatctaattatcactgtgcgttgtatatgggttttggctatttcggtgttcggcggagggacccaggtgaccgtcctacgtcagcccaagg

SEQ ID NO: 586074 - DNA, 517 bp, Homo sapiens
  misc_feature: HIJSMM301B9TKP.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaagtggcaatcaaccgaactgtggctgcaccatctgtcttcatcttccccg

SEQ ID NO: 586075 - DNA, 514 bp, Homo sapiens
  misc_feature: HIJSMM301DXOPV.43.81.H04.1.454.light.4.raw
tgtgagtagtcacgaccggtgctcgatttagtagtgtagattcgcgggggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagcccaaggctgccccctcggtcactctgttcccaccctcctcactac

SEQ ID NO: 586076 - DNA, 500 bp, Homo sapiens
  misc_feature: HIJSMM301CYYH8.43.55.E11.1.454.light.4.raw
tgtgagtagtcacgaccggtgctcgatttagcactcgcacgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaacccta

SEQ ID NO: 586077 - DNA, 503 bp, Homo sapiens
  misc_feature: HIJSMM301EOQ7J.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgtcgccaaggaccgaaggtggaaagtcaaacgaactagtggctgcaccactctgtcttcatcttccccg

SEQ ID NO: 586078 - DNA, 505 bp, Homo sapiens; identical to SEQ ID NO: 551816
  misc_feature: HIJSMM301CB65O.18.78.H01.1.454.light.4.raw

SEQ ID NO: 586079 - DNA, 508 bp, Homo sapiens
  misc_feature: HIJSMM301DXN5Y.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggtcaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactgtggctgcaccatctgtcttcatcttcccgcc

SEQ ID NO: 586080 - DNA, 492 bp, Homo sapiens; identical to SEQ ID NO: 551336
  misc_feature: HIJSMM301ARJKU.5.48.E04.1.454.light.4.raw

SEQ ID NO: 586081 - DNA, 513 bp, Homo sapiens
  misc_feature: HIJSMM301D638A.8.39.D06.1.454.light.4.raw
ctcgcgtgtccacgaccggtgctcgatttagtgacatctcgcagttctttggggcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactgtggctgcaccatctgtcttcatcttcccgccatctgagacacgcga

SEQ ID NO: 586082 - DNA, 500 bp, Homo sapiens
  misc_feature: HIJSMM301C50L0.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctccctgacaatctctgggctccaggctgaggacgagggtgattattactgctgcgcatatagaagtcccactgttgtacttttcggcggagggaccaagctgaccgtcctaggtcagcccaaggctgcccctcggtcactctgttcccgccctcctcgctacgtaga

SEQ ID NO: 586083 - DNA, 504 bp, Homo sapiens
  misc_feature: HIJSMM301A0E3M.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtgggccaagtggaggatgaagctgactactactgttactcaatagagaacagtgataatttctgggtgttcggcggagggaccaaactgaccgtctaggtcagccaaggctgcccctcggtcactctgttcccc

SEQ ID NO: 586084 - DNA, 509 bp, Homo sapiens
  misc_feature: HIJSMM301CVNTM.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagtccaaggctgccccctcggtcattctgtt

SEQ ID NO: 586085 - DNA, 485 bp, Homo sapiens
  misc_feature: HIJSMM301B1ZYP.49.15.B04.1.454.light.4.raw
agtcgagagacacgaccggtgctcgatttagacagtatatatccgcgggcacgaccggtgctcgatttagacagtatatatccgcgggcacgaccggtgctcgatttagtagtgtagattcgcggggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaac

SEQ ID NO: 586086 - DNA, 488 bp, Homo sapiens
  misc_feature: HIJSMM301A8DYN.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattcc

SEQ ID NO: 586087 - DNA, 483 bp, Homo sapiens; identical to SEQ ID NO: 545893
  misc_feature: HIJSMM301CAG6I.3.38.D05.1.454.light.4.raw

SEQ ID NO: 586088 - DNA, 504 bp, Homo sapiens; identical to SEQ ID NO: 562026
  misc_feature: HIJSMM301AT2M5.9.71.G05.1.454.light.4.raw

SEQ ID NO: 586089 - DNA, 490 bp, Homo sapiens; identical to SEQ ID NO: 536855
  misc_feature: HIJSMM301DUWIX.16.68.G02.1.454.light.4.raw

SEQ ID NO: 586090 - DNA, 484 bp, Homo sapiens; identical to SEQ ID NO: 535211
  misc_feature: HIJSMM301CNMSJ.47.46.E02.1.454.light.4.raw

SEQ ID NO: 586091 - DNA, 443 bp, Homo sapiens
  misc_feature: HIJSMM301D7TAV.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaggtcaccgtctaagtcagcccaaggccaaccctctgtcactctgttcccacctcctccatactcgta

SEQ ID NO: 586092 - DNA, 486 bp, Homo sapiens
  misc_feature: HIJSMM301B2URN.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggcctaggggaccaacctggagat

SEQ ID NO: 586093 - DNA, 478 bp, Homo sapiens; identical to SEQ ID NO: 558143
  misc_feature: HIJSMM301C2I6V.12.10.A10.1.454.light.4.raw

SEQ ID NO: 586094 - DNA, 484 bp, Homo sapiens
  misc_feature: HIJSMM301ESQ5O.49.85.H08.1.454.light.4.raw
agtcgagagacacgaccggtgctcgatttagtatcactcagtcgcgggggagtcagtcccaaccaggacacagcatggacatgagggtccctgctcagctcctggggctcctgctgctctggctctcaggtgccagatgtgacatccggatgacccagtctccatcctccctgtccgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccatctgt

SEQ ID NO: 586095 - DNA, 509 bp, Homo sapiens
  misc_feature: HIJSMM301CSKSL.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagacaaagcccccaaactcatcctttatgagggcactaagcggccctcaggggtttctaatcgcttcgctggctccacgtctggcagcacggcctccctgacaatctctgggctccaggctgaggacgaggctgattattactgcatctcatttgtaagcagtagccttgtgttattcggcggagggaccaagctgaccgtctgggtcagcccaaggctgccccctcggtcacttc

SEQ ID NO: 586096 - DNA, 489 bp, Homo sapiens; identical to SEQ ID NO: 552816
  misc_feature: HIJSMM301BC7ET.15.49.E05.1.454.light.4.raw

SEQ ID NO: 586097 - DNA, 463 bp, Homo sapiens; identical to SEQ ID NO: 535062
  misc_feature: HIJSMM301B6IJC.11.73.G07.1.454.light.4.raw

SEQ ID NO: 586098 - DNA, 484 bp, Homo sapiens; identical to SEQ ID NO: 535400
  misc_feature: HIJSMM301ECLJL.46.26.C04.1.454.light.4.raw

SEQ ID NO: 586099 - DNA, 486 bp, Homo sapiens; identical to SEQ ID NO: 535043
  misc_feature: HIJSMM301B0CLQ.46.35.D02.1.454.light.4.raw

SEQ ID NO: 586100 - DNA, 485 bp, Homo sapiens
  misc_feature: HIJSMM301CR7VP.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggatagacttcactctcaccatcagcagactggagcctgaagattttgcagtctattactgtcagcagtatggtcacgtcccaagaacttttggccagggaccaagctggagatcaaacgaactgtggctgcaccat

SEQ ID NO: 586101 - DNA, 489 bp, Homo sapiens; identical to SEQ ID NO: 557621
  misc_feature: HIJSMM301EYONY.13.87.H10.1.454.light.4.raw

SEQ ID NO: 586102 - DNA, 520 bp, Homo sapiens
  misc_feature: HIJSMM301ATN8X.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctcctccgtcgt

SEQ ID NO: 586103 - DNA, 486 bp, Homo sapiens; identical to SEQ ID NO: 560708
  misc_feature: HIJSMM301EKFG3.4.33.C11.1.454.light.4.raw

SEQ ID NO: 586104 - DNA, 486 bp, Homo sapiens; identical to SEQ ID NO: 535385
  misc_feature: HIJSMM301AOCEM.19.71.G05.1.454.light.4.raw

SEQ ID NO: 586105 - DNA, 494 bp, Homo sapiens; identical to SEQ ID NO: 541159
  misc_feature: HIJSMM301A7FEY.15.59.F04.1.454.light.4.raw

SEQ ID NO: 586106 - DNA, 501 bp, Homo sapiens; identical to SEQ ID NO: 536142
  misc_feature: HIJSMM301BFULJ.15.1.A01.1.454.light.4.raw

SEQ ID NO: 586107 - DNA, 496 bp, Homo sapiens; identical to SEQ ID NO: 549465
  misc_feature: HIJSMM301CLK3A.3.31.C09.1.454.light.4.raw

SEQ ID NO: 586108 - DNA, 503 bp, Homo sapiens
  misc_feature: HIJSMM301BPX40.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatggaggctgattattattgcagctcatatgcaggcagttacaatgtgatattcggcggagggaccaaactgaccgtcctaggtcagcccaaggctgccccctc

SEQ ID NO: 586109 - DNA, 506 bp, Homo sapiens
  misc_feature: HIJSMM301BSSJ1.15.66.F11.1.454.light.4.raw
tctacgtagccacgaccggtgctcgatttagtcacgcgagaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttcttgcggctcatatggagacaattacagctttgtcttcggaagtgggaccaaggtcaccgtcctaagtcagcccaaggctgccccctcggtcactctgttcccaccct

SEQ ID NO: 586110 - DNA, 463 bp, Homo sapiens
  misc_feature: HIJSMM301D1SZN.40.2.A02.1.454.light.4.raw
tctagcgactcacgaccggtgctcgatttagactcatctacaggggggagtcagacccactcaggacacagcatggacatgagggtccccgctcagctcctggggctcctgctgctctggctcccaggcgccagatgtgccatccagatgacccagtctccatcctcactgtctgcatctgtaggagacagagtcaccatcacttgccgggcaagtcagggcattggaaatgatttagcctggtatcagcagaaaccaggaaaagcccctcagctcctgatctatactgcatccactttacaaagtggagtcccatcaaggttcagcggcagtggatctggcacagatttcactctcaccatcagcagcctgcagcctgaagattttgcaacttattactgtctacaagattacaattaccctcggacttttggccaggggacctggctggagatcaaacgaa

SEQ ID NO: 586111 - DNA, 493 bp, Homo sapiens
  misc_feature: HIJSMM301DV9JW.41.74.G08.1.454.light.4.raw
tctatactatcacgaccggtgctcgatttagtagctctatcagggggagctacaacaggcaggcaggggcagcaagatggtgttgcagacccaggtcttcatttctctgttgctctggatctctggcgcctacggggacatcgtgatgacccagtctccagactccctggcagtgtctctgggcgggagggccaccatcaactgcaagtccagccagactattttatacggctcctacaataagaacgacttagcttggtaccagcagaaaccaggacagcctcctaagttgctcatttactgggcatctaaccgcatatccggtgtccctgaccgattcaatgccagcgggtctgggacagatttcactctcaccatcagcagcctgcaggctgaggatgtggcagtttattactgtcatcaatattatactactccgtggacgttcggccaagggaccaaggtggaattgaaacgaactgtggctgcacca

SEQ ID NO: 586112 - DNA, 493 bp, Homo sapiens
  misc_feature: HIJSMM301B8MJL.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcagcactgttttggcggttctccgactttcggcggagggaccgaaggtggaggtcaaacgaactgtggctgcaccatctgtcttcatcttcccgccat

SEQ ID NO: 586113 - DNA, 501 bp, Homo sapiens; identical to SEQ ID NO: 555276
  misc_feature: HIJSMM301B5IBU.22.21.B10.1.454.light.4.raw

SEQ ID NO: 586114 - DNA, 485 bp, Homo sapiens; identical to SEQ ID NO: 535501
  misc_feature: HIJSMM301B8GHZ.3.10.A10.1.454.light.4.raw

SEQ ID NO: 586115 - DNA, 515 bp, Homo sapiens
  misc_feature: HIJSMM301BTAF5.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtcgtccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagttgggtctgggacagacttcactctcaccatcagtagactggagcctgaagtattttgcagtttattactgtcagcagtagtgggggctcacgtcgattctacttttccggcccgtcgggaccgaaagtagatgtacaaacgaaactgtggctgcacatctgttctt

SEQ ID NO: 586116 - DNA, 482 bp, Homo sapiens
  misc_feature: HIJSMM301AMI0R.5.39.D06.1.454.light.4.raw
atcagacacgcacgaccggtgctcgatttagtgacatctcgcagttctttggggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttattactgccaacaatataatagttattggacgttcggccaggggaccaaggtcgaaatgagacgaactgtggctgcacat

SEQ ID NO: 586117 - DNA, 514 bp, Homo sapiens
  misc_feature: HIJSMM301C2CC4.51.53.E09.1.454.light.4.raw
cgatcgtatacacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacaacttgggtgttcggcggcgggaccaaactgaccgtcctacgtcagcccaaggctgccccctcggtcactctgtt

SEQ ID NO: 586118 - DNA, 485 bp, Homo sapiens; identical to SEQ ID NO: 538787
  misc_feature: HIJSMM301DW0I4.49.57.F02.1.454.light.4.raw

SEQ ID NO: 586119 - DNA, 494 bp, Homo sapiens; identical to SEQ ID NO: 535680
  misc_feature: HIJSMM301CVDA8.16.78.H01.1.454.light.4.raw

SEQ ID NO: 586120 - DNA, 444 bp, Homo sapiens; identical to SEQ ID NO: 535192
  misc_feature: HIJSMM301DUFW4.5.9.A09.1.454.light.4.raw

SEQ ID NO: 586121 - DNA, 498 bp, Homo sapiens; identical to SEQ ID NO: 550538
  misc_feature: HIJSMM301ECW89.52.29.C07.1.454.light.4.raw

SEQ ID NO: 586122 - DNA, 473 bp, Homo sapiens
  misc_feature: HIJSMM301AT5DT.12.49.E05.1.454.light.4.raw
  modified_base (422)..(422): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtntaacagtgcccccttcaccttcggccaagggacacgactggagattagacg

SEQ ID NO: 586123 - DNA, 474 bp, Homo sapiens; identical to SEQ ID NO: 534975
  misc_feature: HIJSMM301C4M8I.40.59.F04.1.454.light.4.raw

SEQ ID NO: 586124 - DNA, 495 bp, Homo sapiens
  misc_feature: HIJSMM301BD6CE.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaactctgggaacacagccactctgaccatcagcgggacccaacttttagatgaggccgactatttctgtcacacgtgggacatgggcactgcgatcttcggcggagggaccaagctgaccgtcctgggtcagcccaaggctgccccctcggtctac

SEQ ID NO: 586125 - DNA, 502 bp, Homo sapiens; identical to SEQ ID NO: 539314
  misc_feature: HIJSMM301CONHE.21.81.H04.1.454.light.4.raw

SEQ ID NO: 586126 - DNA, 488 bp, Homo sapiens
  misc_feature: HIJSMM301ALWRK.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtggaccaagctgaccgtcctaggtcagccc

SEQ ID NO: 586127 - DNA, 479 bp, Homo sapiens; identical to SEQ ID NO: 536050
  misc_feature: HIJSMM301C1EB0.5.73.G07.1.454.light.4.raw

SEQ ID NO: 586128 - DNA, 489 bp, Homo sapiens
  misc_feature: HIJSMM301AHTL1.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttggccgggcgagtcacgacattaacacttatttagcctggtatcagcagaagccagggagagtccctaaattattgatctctgctgcgtccgccttgcaatcgggggtccatctcggttcagtggcggtggatctaggacagaattcactctcaccatcaccaacctgcaccctgaagatgttggaagttattactgtcagacctatagtggtcggcccgctctattttcggcgggagggaccgaaggtgcagatacaaacgaactgtggctgca

SEQ ID NO: 586129 - DNA, 476 bp, Homo sapiens
  misc_feature: HIJSMM301E3IFQ.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgctaacttacttttgtcaacaggctcagagtttcccgctcactttcggcggagggaccaaggtggagatacaaacgaactgtgg

SEQ ID NO: 586130 - DNA, 505 bp, Homo sapiens
  misc_feature: HIJSMM301BYYZA.18.59.F04.1.454.light.4.raw
tacgagtatgcacgaccggtgctcgatttagtacacacacttagggagttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacatcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaacccac

SEQ ID NO: 586131 - DNA, 494 bp, Homo sapiens; identical to SEQ ID NO: 534992
  misc_feature: HIJSMM301C1OA7.9.1.A01.1.454.light.4.raw

SEQ ID NO: 586132 - DNA, 505 bp, Homo sapiens
  misc_feature: HIJSMM301DPD3K.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccaaggtaggaaatcaaacgaactagtggcgtgcaccatctgtcttcatcttccccg

SEQ ID NO: 586133 - DNA, 486 bp, Homo sapiens
  misc_feature: HIJSMM301CT4MB.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtggagatacaaacgaactgtggctgcacca

SEQ ID NO: 586134 - DNA, 505 bp, Homo sapiens; identical to SEQ ID NO: 536117
  misc_feature: HIJSMM301BR14C.8.71.G05.1.454.light.4.raw

SEQ ID NO: 586135 - DNA, 521 bp, Homo sapiens; identical to SEQ ID NO: 538715
  misc_feature: HIJSMM301A90DQ.27.23.C01.1.454.light.4.raw

SEQ ID NO: 586136 - DNA, 518 bp, Homo sapiens
  misc_feature: HIJSMM301CY8HS.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggctgccccctcggtcactctgttccgcct

SEQ ID NO: 586137 - DNA, 478 bp, Homo sapiens
  misc_feature: HIJSMM301D80JT.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctcgacgttcgcaggaccaggtgaatcaacgaactgtgctgcaccat

SEQ ID NO: 586138 - DNA, 441 bp, Homo sapiens; identical to SEQ ID NO: 535074
  misc_feature: HIJSMM301DDGVW.11.3.A03.1.454.light.4.raw

SEQ ID NO: 586139 - DNA, 484 bp, Homo sapiens; identical to SEQ ID NO: 560362
  misc_feature: HIJSMM301AFZB6.21.25.C03.1.454.light.4.raw

SEQ ID NO: 586140 - DNA, 501 bp, Homo sapiens
  misc_feature: HIJSMM301AGJYL.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtaggaaatacaaacgaactagtggctgcacc

SEQ ID NO: 586141 - DNA, 484 bp, Homo sapiens; identical to SEQ ID NO: 535211
  misc_feature: HIJSMM301AS068.47.46.E02.1.454.light.4.raw

SEQ ID NO: 586142 - DNA, 500 bp, Homo sapiens
  misc_feature: HIJSMM301CNCYE.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccgaaggtggaggatgaaaagaaacgtagtggctgcacccatcttcg

SEQ ID NO: 586143 - DNA, 513 bp, Homo sapiens
  misc_feature: HIJSMM301A3MNX.43.13.B02.1.454.light.4.raw
tgtgagtagtcacgaccggtgctcgatttagtctagcgacttccgcggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgacttattactgtcgaggcggtcgggacaatcagtcgtaggtggaagggtcggttttacgggccggtagggacccgaacggacgttgaaccggtccctaaaggtcctacggccccctaac

SEQ ID NO: 586144 - DNA, 484 bp, Homo sapiens
  misc_feature: HIJSMM301BAIGD.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctggaccaggtcaccgtcctaggtcagcccaaggccaaccc

SEQ ID NO: 586145 - DNA, 505 bp, Homo sapiens
  misc_feature: HIJSMM301DUITT.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcggggtagaaagcggccctcagggatccctgagcgcttctctggatccaactctgggaacacagccactctgaccatcagcgggaccctaactttagatgaggccgactatttctgtcacacgtgggacagtggcactgcgatcgttcggcgggaggaccaagctcgaccgtccgtggtcacgcccgaaggctcgccccctcggtcactctcccg

SEQ ID NO: 586146 - DNA, 500 bp, Homo sapiens; identical to SEQ ID NO: 541228
  misc_feature: HIJSMM301DNJAO.13.11.A11.1.454.light.4.raw

SEQ ID NO: 586147 - DNA, 496 bp, Homo sapiens
  misc_feature: HIJSMM301CK6UT.12.38.D05.1.454.light.4.raw
atacgacgtacacgaccggtgctcgatttagtatctgatagttgggtttgggggaactgctcagttaggacccagacggaaccatggaagccccagcgcagcttctcttcctcctgctactctggctcccagattcctctggagaagttgtgatgacgcagtctccagccaccctgtctgcgtctccaggggaaagagtcaccctctcatgcagggccagtgagattgttaccaccaacttagcctggtaccaacagaaacctggccagcctcccaggctcctcatttatggtgcatccacaagggccgctggtgtcccagccaggttcagtggcagtggatctgcgacagagttcactctcaccgtcagcagcctgcagtctgaagattttgcagtttattactgtcagcagtatgagaagtggttcaagactttcggcggagggaccgaaggtggagatcaaacgaactgtggctgcaccactctgtcttcatt

SEQ ID NO: 586148 - DNA, 484 bp, Homo sapiens
  misc_feature: HIJSMM301DEB4O.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcttcggccaggggaccaaggtggaagtcaagcgaactgtggctgcacatct

SEQ ID NO: 586149 - DNA, 444 bp, Homo sapiens; identical to SEQ ID NO: 535594
  misc_feature: HIJSMM301A3RES.9.9.A09.1.454.light.4.raw

SEQ ID NO: 586150 - DNA, 499 bp, Homo sapiens; identical to SEQ ID NO: 537739
  misc_feature: HIJSMM301A0GDR.12.86.H09.1.454.light.4.raw

SEQ ID NO: 586151 - DNA, 497 bp, Homo sapiens; identical to SEQ ID NO: 542406
  misc_feature: HIJSMM301DO66G.9.53.E09.1.454.light.4.raw

SEQ ID NO: 586152 - DNA, 485 bp, Homo sapiens
  misc_feature: HIJSMM301AWNAB.48.22.B11.1.454.light.4.raw
agtatacatacacgaccggtgctcgatttagacgacagctcaggggagtcccagtcaggacacagcatggacatgagggtccccgctcagctcctggggctcctgctgctctggctcccaggtgccagatgtgccatccagttgacccagtctccatcttccctgtctgcatctgtaggagacagagtctccatcacttgccgggccagtcagggcattagaagttatttagcctggtttcagcagaaaccagggaaagcccctaaactcctgatctacgctgcatccactttgcacagtggggtcccgtctaggttcagcggcagcggatctgggacagatttcactctcaccatcagcagcctgcagcctgaagatgttgcaacttattactgtcaacagcttagtagtaaccctccgtacacttttggccagggaccaaggtggagatcaaacgaaactgtggctgcaccatctgtcttcta

SEQ ID NO: 586153 - DNA, 505 bp, Homo sapiens
  misc_feature: HIJSMM301CHTCE.19.78.H01.1.454.light.4.raw
tactctcgtgcacgaccggtgctcgatttagtgtgagtagtttgggtttgggggggtcacaagaggcagcgctctcgggacgtctccaccatggcctgggctctgctgctcctcactctcctcactcaggacacagggtccgtgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaacccactgtca

SEQ ID NO: 586154 - DNA, 488 bp, Homo sapiens; identical to SEQ ID NO: 563619
  misc_feature: HIJSMM301AO2F0.3.55.E11.1.454.light.4.raw

SEQ ID NO: 586155 - DNA, 484 bp, Homo sapiens; identical to SEQ ID NO: 535400
  misc_feature: HIJSMM301B5OLH.46.26.C04.1.454.light.4.raw

SEQ ID NO: 586156 - DNA, 488 bp, Homo sapiens; identical to SEQ ID NO: 555249
  misc_feature: HIJSMM301DV21F.17.34.D01.1.454.light.4.raw

SEQ ID NO: 586157 - DNA, 499 bp, Homo sapiens; identical to SEQ ID NO: 547044
  misc_feature: HIJSMM301EVFQS.43.71.G05.1.454.light.4.raw

SEQ ID NO: 586158 - DNA, 484 bp, Homo sapiens; identical to SEQ ID NO: 574671
  misc_feature: HIJSMM301EBGSE.4.27.C05.1.454.light.4.raw

SEQ ID NO: 586159 - DNA, 492 bp, Homo sapiens
  misc_feature: HIJSMM301E37R9.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactaactgtcaacagagttacagtacccccctcactttcggcggagggaccaaaggcggagatcagacgaactgtggctgcaccaatctgtcttcta

SEQ ID NO: 586160 - DNA, 495 bp, Homo sapiens
  misc_feature: HIJSMM301AEBE3.51.34.D01.1.454.light.4.raw
cgatcgtatacacgaccggtgctcgatttagatcgtctgtgttgggtttggggtgggggcacttctccctctaacactcttccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagctcctaaactcctgatctatgaggcatccactttacaatcaggggtcccatctcgtttcagtggcagtggatctggggcacatttcactctcaccatcagcagcctgcagcctgacgatgttgcaacttattactgtcaaaattataacaggccgttgcgctcacttcgtcgggggaccggaacggtggtaggatcaagacgaacgtacgtggcgtgtcgaccactactcgttcg

SEQ ID NO: 586161 - DNA, 509 bp, Homo sapiens
  misc_feature: HIJSMM301DJ896.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccgaaggtaggaaagtacaaacgaactagtggctgcaccatctgtcttctatcttccccg

SEQ ID NO: 586162 - DNA, 505 bp, Homo sapiens
  misc_feature: HIJSMM301C1WMH.4.21.B10.1.454.light.4.raw
agcactgtagcacgaccggtgctcgatttagtgtcgtcgcaagagagagaggggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtctaggtcagccaaggctcgccccctcggtcactctcgtt

SEQ ID NO: 586163 - DNA, 500 bp, Homo sapiens
  misc_feature: HIJSMM301ADA09.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccctc

SEQ ID NO: 586164 - DNA, 513 bp, Homo sapiens
  misc_feature: HIJSMM301BAT83.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgccaggaccgaaggtaggaagtacaacgaactagtggcgtgcaccatctgtcttctatcttcccgtccactctcgat

SEQ ID NO: 586165 - DNA, 478 bp, Homo sapiens
  misc_feature: HIJSMM301EASRE.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttcagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactgcctccgtacagttttggccagggaccaagctggagatcaaacgaa

SEQ ID NO: 586166 - DNA, 489 bp, Homo sapiens; identical to SEQ ID NO: 535139
  misc_feature: HIJSMM301ELW30.14.55.E11.1.454.light.4.raw

SEQ ID NO: 586167 - DNA, 519 bp, Homo sapiens
  misc_feature: HIJSMM301CYCGG.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagtagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctcgccccctcggtcactctgttcccaccctcctcctacg

SEQ ID NO: 586168 - DNA, 482 bp, Homo sapiens
  misc_feature: HIJSMM301A96IT.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccaggctcctcatctatgatgcatccacaagggccactgatatcccagccaggttcagtggcagtgggtctgggacagagttcactctcaccatcagcagcctgcagtctgaagattttgcaatttattactgtcagcagtataataactggcctccgtacacttttggccaggggaccaagctggagatcaaacgaactgtggctgcaccta

SEQ ID NO: 586169 - DNA, 493 bp, Homo sapiens; identical to SEQ ID NO: 574530
  misc_feature: HIJSMM301DUCFJ.18.11.A11.1.454.light.4.raw

SEQ ID NO: 586170 - DNA, 485 bp, Homo sapiens
  misc_feature: HIJSMM301EV1SD.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgcagtttattactgtcagcattacaataactggcctcggctcactttcggcggagggccaaggtggagatcaaacgaactgtggctgcaccat

SEQ ID NO: 586171 - DNA, 494 bp, Homo sapiens; identical to SEQ ID NO: 534994
  misc_feature: HIJSMM301EHMGT.27.78.H01.1.454.light.4.raw

SEQ ID NO: 586172 - DNA, 479 bp, Homo sapiens; identical to SEQ ID NO: 542895
  misc_feature: HIJSMM301C24GM.40.59.F04.1.454.light.4.raw

SEQ ID NO: 586173 - DNA, 447 bp, Homo sapiens; identical to SEQ ID NO: 535020
  misc_feature: HIJSMM301AYM61.18.9.A09.1.454.light.4.raw

SEQ ID NO: 586174 - DNA, 494 bp, Homo sapiens; identical to SEQ ID NO: 535276
  misc_feature: HIJSMM301AVHWW.16.6.A06.1.454.light.4.raw

SEQ ID NO: 586175 - DNA, 497 bp, Homo sapiens; identical to SEQ ID NO: 535740
  misc_feature: HIJSMM301EXE3L.3.71.G05.1.454.light.4.raw

SEQ ID NO: 586176 - DNA, 496 bp, Homo sapiens; identical to SEQ ID NO: 540257
  misc_feature: HIJSMM301CU32Y.41.6.A06.1.454.light.4.raw

SEQ ID NO: 586177 - DNA, 509 bp, Homo sapiens; identical to SEQ ID NO: 535670
  misc_feature: HIJSMM301CMFTZ.47.23.C01.1.454.light.4.raw

SEQ ID NO: 586178 - DNA, 500 bp, Homo sapiens; identical to SEQ ID NO: 540219
  misc_feature: HIJSMM301CMRLN.43.34.D01.1.454.light.4.raw

SEQ ID NO: 586179 - DNA, 486 bp, Homo sapiens; identical to SEQ ID NO: 535043
  misc_feature: HIJSMM301CZUC6.46.35.D02.1.454.light.4.raw

SEQ ID NO: 586180 - DNA, 520 bp, Homo sapiens
  misc_feature: HIJSMM301ECLA9.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggtccgaacgggaccgaacggtaggaaggtacgaaacgaactagtggcgtgcaccactctgtcttctactcttcccgtccact

SEQ ID NO: 586181 - DNA, 500 bp, Homo sapiens; identical to SEQ ID NO: 540012
  misc_feature: HIJSMM301D4FFS.52.34.D01.1.454.light.4.raw

SEQ ID NO: 586182 - DNA, 497 bp, Homo sapiens
  misc_feature: HIJSMM301B5ARZ.22.14.B03.1.454.light.4.raw
  modified_base (446)..(446): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcanacgttcggccaagggaccaaggtggaaatcaaagaactgtggctgcaccta

SEQ ID NO: 586183 - DNA, 492 bp, Homo sapiens
  misc_feature: HIJSMM301AXA7Y.40.22.B11.1.454.light.4.raw
tctagcgactcacgaccggtgctcgatttagacgacagctcagggcacgaccggtgctcgatttagacgacagctcagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagagtggaggctgaggatgttggggtttattactgcatgcaagctctacaaattcctcggacgttcggccgaaggacc

SEQ ID NO: 586184 - DNA, 493 bp, Homo sapiens; identical to SEQ ID NO: 544835
  misc_feature: HIJSMM301DQFZV.43.29.C07.1.454.light.4.raw

SEQ ID NO: 586185 - DNA, 489 bp, Homo sapiens; identical to SEQ ID NO: 535139
  misc_feature: HIJSMM301CWSOP.14.55.E11.1.454.light.4.raw

SEQ ID NO: 586186 - DNA, 492 bp, Homo sapiens
  misc_feature: HIJSMM301AJJEU.49.7.A07.1.454.light.4.raw
agtcgagagacacgaccggtgctcgatttagcacgtgtcgcaggggggtagctcaggaagcagagcctggagcatctccactatggcctgggctccactacttctcaccctcctcgctcactgcacaggttcttgggccaatttgatgctgattcagccccactctgtgtcggagtctccggggaagacggtaaccatctcctgcaccggcagcagtggcagcattggcagcaactatgtgcagtggtaccagcagcgcccgggcagtgcccccaccaccgtgatctatggggataacgaaagaccctctggggtccctgatcgattctctggctccatcgacagctcctccaagtctgcctccctcaccatctctggactgaagactgaggacgaggctgactactattgtcagacgtatgattataacacctgggtgttcggcggagggaccaagctgaccgtcctaagtcagcccaaggctgccccctc

SEQ ID NO: 586187 - DNA, 488 bp, Homo sapiens; identical to SEQ ID NO: 571847
  misc_feature: HIJSMM301BM79O.11.28.C06.1.454.light.4.raw

SEQ ID NO: 586188 - DNA, 383 bp, Homo sapiens; identical to SEQ ID NO: 447524
  misc_feature: HIJSMM301BCPQ5.41.26.C04.1.454.light.4.raw

SEQ ID NO: 586189 - DNA, 478 bp, Homo sapiens; identical to SEQ ID NO: 535129
  misc_feature: HIJSMM301AFFFT.11.11.A11.1.454.light.4.raw

SEQ ID NO: 586190 - DNA, 501 bp, Homo sapiens
  misc_feature: HIJSMM301EPK88.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgttcggtccaacgggaccgaacggtaggaaagtacaaacgaaactagtggctgcaccactctgtt

SEQ ID NO: 586191 - DNA, 495 bp, Homo sapiens
  misc_feature: HIJSMM301CCF1P.41.49.E05.1.454.light.4.raw
tctatactatcacgaccggtgctcgatttagagcgactagcaacacacaaagggggaggaactgctcagttaggacccagagggaaccatggaagccccagctcagcttctcttcctcctgctactctggctcccagataccaccggagaaattgtgttgacacagtctccagccaccctgtctctgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagaacctgaagattttgcaatttattactgtcagcagcgtatcaactggcctccgtggacgttcggccaagggaccaaggtggaaagtcaaacgaactagtggctgcaccatct

SEQ ID NO: 586192 - DNA, 506 bp, Homo sapiens; identical to SEQ ID NO: 534969
  misc_feature: HIJSMM301CI99N.18.37.D04.1.454.light.4.raw

SEQ ID NO: 586193 - DNA, 464 bp, Homo sapiens; identical to SEQ ID NO: 537111
  misc_feature: HIJSMM301CY8CE.17.28.C06.1.454.light.4.raw

SEQ ID NO: 586194 - DNA, 498 bp, Homo sapiens
  misc_feature: HIJSMM301B8CA8.10.37.D04.1.454.light.4.raw
catagtagtgcacgaccggtgctcgatttagtagcatactgttgggtttgggggctctggggaggaactgctcagttaggacccagacggaaccatggaagccccagcgcagcttctcttcctcctgctactctggctcccagattccactggagaaatagttttgacgcaatctccagccaccctgtctgtgactccaggtgagagagccaccctctcttgcagggccagtcaggggatcagcagcaatttagcctggtaccaacagaagcctggccaggttcccagactcctcatatatgaagcctcttccagggccactggagtcccagccaggttcagcggcggtgggtctgggacagacttcactctcaccatcagcagcctgcagtctgaggaccttggagtttattactgtcagcagtatcataactggcctccgtggacgttcggccaagggaccaaggtggacctcaaacgaactagtggctgcaccat

SEQ ID NO: 586195 - DNA, 500 bp, Homo sapiens
  misc_feature: HIJSMM301DAOZ5.41.18.B07.1.454.light.4.raw
tctatactatcacgaccggtgctcgatttagtcgctgcgtaaggggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccgaagctgaccgtcctaggtcagcccaaggctgccccctcggtcactctcg

SEQ ID NO: 586196 - DNA, 488 bp, Homo sapiens
  misc_feature: HIJSMM301AQTVS.47.38.D05.1.454.light.4.raw
agctcacgtacacgaccggtgctcgatttagtatctgatagttgggtttgggggactgatcaggactcctcagttcaccttctcacgaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaaacgaa

SEQ ID NO: 586197 - DNA, 509 bp, Homo sapiens; identical to SEQ ID NO: 565047
  misc_feature: HIJSMM301BBWP8.18.37.D04.1.454.light.4.raw

SEQ ID NO: 586198 - DNA, 486 bp, Homo sapiens
  misc_feature: HIJSMM301A2XM5.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttggttctaatcgggcctccggggtccctgacaggttcagtggcagtggatcaggcacagtattttacactagaaaatcagcagagtggaggctgaggatgttgggctctattattgcatgcaagctctacaagtcccgctcactttcggcggaggaccgaaggtggagatacaaacgaa

SEQ ID NO: 586199 - DNA, 447 bp, Homo sapiens; identical to SEQ ID NO: 535020
  misc_feature: HIJSMM301EF7IW.18.9.A09.1.454.light.4.raw

SEQ ID NO: 586200 - DNA, 494 bp, Homo sapiens; identical to SEQ ID NO: 534994
  misc_feature: HIJSMM301AMSWJ.27.78.H01.1.454.light.4.raw

SEQ ID NO: 586201 - DNA, 501 bp, Homo sapiens
  misc_feature: HIJSMM301EE35N.48.70.G04.1.454.light.4.raw
agtatacatacacgaccggtgctcgatttagtgtagtgtgaagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagtacttttagttacgtcggaccttcggccaaggacacgactggagattaaacgaactgtggctgcacc

SEQ ID NO: 586202 - DNA, 486 bp, Homo sapiens; identical to SEQ ID NO: 535290
  misc_feature: HIJSMM301AXBXR.3.12.B01.1.454.light.4.raw

SEQ ID NO: 586203 - DNA, 520 bp, Homo sapiens
  misc_feature: HIJSMM301CY7JQ.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtcacctctgttcccaccctcctccacg

SEQ ID NO: 586204 - DNA, 485 bp, Homo sapiens; identical to SEQ ID NO: 535501
  misc_feature: HIJSMM301DJ3AF.3.10.A10.1.454.light.4.raw

SEQ ID NO: 586205 - DNA, 496 bp, Homo sapiens
  misc_feature: HIJSMM301ASA6O.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatacaaacgaactgtggctgca

SEQ ID NO: 586206 - DNA, 443 bp, Homo sapiens
  misc_feature: HIJSMM301EZT3C.14.76.G10.1.454.light.4.raw
cgtctagtaccacgaccggtgctcgatttagtcactcatacagggtcctgggcccagtctgtgctgactcagccaccctcagcgtctgggccccccgggcagagggtctccatctcttgttctggagtcacttccaacatcggaaataatgatgtgagctggtaccagcaggtcccaggaacggcccccaaactcctcatctataccaatgatgtgcggccctcaggggtccctgaccgattctctgcctccaagtctggcacgtcagccttcctggacatccgtggcctccagtctgcggatgaggctgtttatttctgttcagcacgggatgccagccggaatggcaattgggtattcggcggaggaccaagttgaccgtcctaagtcagcccaaggctgccccctcggtcactctgttcccaccctcctcgtactagacg

SEQ ID NO: 586207 - DNA, 485 bp, Homo sapiens; identical to SEQ ID NO: 535880
  misc_feature: HIJSMM301AR9D7.7.75.G09.1.454.light.4.raw

SEQ ID NO: 586208 - DNA, 509 bp, Homo sapiens; identical to SEQ ID NO: 541168
  misc_feature: HIJSMM301ERSX2.5.60.F05.1.454.light.4.raw

SEQ ID NO: 586209 - DNA, 497 bp, Homo sapiens; identical to SEQ ID NO: 543330
  misc_feature: HIJSMM301AYB0C.9.39.D06.1.454.light.4.raw

SEQ ID NO: 586210 - DNA, 517 bp, Homo sapiens; identical to SEQ ID NO: 546084
  misc_feature: HIJSMM301AG7J7.47.53.E09.1.454.light.4.raw

SEQ ID NO: 586211 - DNA, 504 bp, Homo sapiens
  misc_feature: HIJSMM301DCIB3.9.53.E09.1.454.light.4.raw
tgatacgtctcacgaccggtgctcgatttagagagagtgtgttgggtttggggggggtcacagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgtccccccg

SEQ ID NO: 586212 - DNA, 485 bp, Homo sapiens; identical to SEQ ID NO: 538787
  misc_feature: HIJSMM301D1CD4.49.57.F02.1.454.light.4.raw

SEQ ID NO: 586213 - DNA, 484 bp, Homo sapiens; identical to SEQ ID NO: 535240
  misc_feature: HIJSMM301DN5MF.47.60.F05.1.454.light.4.raw

SEQ ID NO: 586214 - DNA, 493 bp, Homo sapiens; identical to SEQ ID NO: 571339
  misc_feature: HIJSMM301BL51D.10.72.G06.1.454.light.4.raw

SEQ ID NO: 586215 - DNA, 474 bp, Homo sapiens; identical to SEQ ID NO: 580149
  misc_feature: HIJSMM301DD5W0.7.81.H04.1.454.light.4.raw

SEQ ID NO: 586216 - DNA, 354 bp, Homo sapiens; identical to SEQ ID NO: 535026
  misc_feature: HIJSMM301DFFAT.19.22.B11.1.454.light.4.raw

SEQ ID NO: 586217 - DNA, 501 bp, Homo sapiens; identical to SEQ ID NO: 535746
  misc_feature: HIJSMM301AJCH3.18.11.A11.1.454.light.4.raw

SEQ ID NO: 586218 - DNA, 507 bp, Homo sapiens
  misc_feature: HIJSMM301DLONP.48.66.F11.1.454.light.4.raw
agtatacatacacgaccggtgctcgatttagtcacgcgagaagggcttgatgccttggggaagcctgagaacacttagccttcatgagtgtccccaccatggcctggatgatgcttctcctcggactccttgcttatggatcaggcgttgcattctcagagtgtggtgacccaggaaccatcgttctcagtgtcccctggagggacagtcacactcacttgtggcttgacttctggctcagtcgcgccggtccactaccccagttggtaccaacagatcccaggccaggctccacgcacgctcatcttcatgaaacagattcgctcttctggggtccctgatcggtttctggctccatcgttggggcaaagccgccctcaccatcacgggggcccaggcagaggatgaggcgaattattattgtatgctccacaggggcaggggcacctgggagttcggcggcgggaccaagctgaccgtcctaggtcagcccaaggctgccccctc

SEQ ID NO: 586219 - DNA, 504 bp, Homo sapiens
  misc_feature: HIJSMM301DQBIX.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttggcactactgtcgtttgggttggttcggtcggagggaccgaagttgaccgtcctaggtcagccaaggctaagccccctcggtc

SEQ ID NO: 586220 - DNA, 478 bp, Homo sapiens
  misc_feature: HIJSMM301B8W9C.8.53.E09.1.454.light.4.raw
  modified_base (408)..(408): a, c, t, g, unknown or other
ctcgcgtgtccacgaccggtgctcgatttagagagagtgtgttgggtttgggggctctgcttcagctgtgggcacaagaggcagcactcaggacaatctccagcatggcctggtctcctctcctcctcactctcctcgctcactgcacagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtnaggatgaggctgattattactgccactcctatgacaacagcctgagtatttggctgttcggcgcgggacc

SEQ ID NO: 586221 - DNA, 495 bp, Homo sapiens
  misc_feature: HIJSMM301DEOKR.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctctttcggaactgggaccacggtcaccgtctaggtcagcccaaggcccaaccca

SEQ ID NO: 586222 - DNA, 521 bp, Homo sapiens; identical to SEQ ID NO: 539470
  misc_feature: HIJSMM301AMN01.27.23.C01.1.454.light.4.raw

SEQ ID NO: 586223 - DNA, 461 bp, Homo sapiens
  misc_feature: HIJSMM301AU71Z.11.86.H09.1.454.light.4.raw
cgagagataccacgaccggtgctcgatttagtgctatagacttgggtttgggggccgttcctgggcccagtctgtgctgactcagccaccctcagcgtctgggacccccgggcagagggtcatcatctcttgttctggaagcagctctaatatcggaagtaatactgtaaattggtatcaacaactcccaggaacggcccccaaactcctcatctatagtaataatcagcggccctcaggggtccctgaccgattctctggctccaagtctggcacctcagcctccctggccatcagtgggctccagtctgatgatgaggctgattattactgtgcagcatgggatgacaccctgaatggtccttgtgtggttttcggcggagggaccaagctgaccgtcctaggtcagcccaaggctgccccctcggtcactcctgttccccacctcctcgtatctctcg

SEQ ID NO: 586224 - DNA, 495 bp, Homo sapiens; identical to SEQ ID NO: 536931
  misc_feature: HIJSMM301EW5JM.10.33.C11.1.454.light.4.raw

SEQ ID NO: 586225 - DNA, 493 bp, Homo sapiens
  misc_feature: HIJSMM301E1R9O.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaaactccttacactttttggccaggggaccaagctggagatcaaacgaactgt

SEQ ID NO: 586226 - DNA, 476 bp, Homo sapiens; identical to SEQ ID NO: 560517
  misc_feature: HIJSMM301A12GW.49.50.E06.1.454.light.4.raw

SEQ ID NO: 586227 - DNA, 493 bp, Homo sapiens; identical to SEQ ID NO: 536246
  misc_feature: HIJSMM301BH665.49.66.F11.1.454.light.4.raw

SEQ ID NO: 586228 - DNA, 441 bp, Homo sapiens; identical to SEQ ID NO: 534971
  misc_feature: HIJSMM301BC11Z.11.3.A03.1.454.light.4.raw

SEQ ID NO: 586229 - DNA, 487 bp, Homo sapiens
  misc_feature: HIJSMM301B0BK1.52.44.D11.1.454.light.4.raw
cgcagtacgacacgaccggtgctcgatttagcgcagtacgaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgctctggaaccagcagtgatgttggtaactataactctgtctcctggtaccaacagcacccaggcaaagccccccaactcataattcatgatgtcactaagcggccctcaggggtccctggtcgtttctctgcctccaagtctggcaacacggcctccctgaccatctctgggctccaggctgaggatgaggctgattattactgctgctcatatgcaggcagcaacacttatgtcttcggaactgggaccaaggtcaccgtctaggtcagcccaacgg

SEQ ID NO: 586230 - DNA, 514 bp, Homo sapiens
  misc_feature: HIJSMM301BHHBW.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgtccacggaccgacgacgtagaaagtagtagacgaactacgtggcgtggcaccgactctgtcttctactcttcccgt

SEQ ID NO: 586231 - DNA, 479 bp, Homo sapiens; identical to SEQ ID NO: 542895
  misc_feature: HIJSMM301CUQYP.40.59.F04.1.454.light.4.raw

SEQ ID NO: 586232 - DNA, 496 bp, Homo sapiens; identical to SEQ ID NO: 537225
  misc_feature: HIJSMM301DKMZ3.11.59.F04.1.454.light.4.raw

SEQ ID NO: 586233 - DNA, 472 bp, Homo sapiens; identical to SEQ ID NO: 536302
  misc_feature: HIJSMM301DQ43Z.18.76.G10.1.454.light.4.raw

SEQ ID NO: 586234 - DNA, 499 bp, Homo sapiens
  misc_feature: HIJSMM301BIGR9.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctaccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaaggtggagatcaaaacgactgtggctgcaccatcctgtcttcatcttcccgccatctgac

SEQ ID NO: 586235 - DNA, 454 bp, Homo sapiens; identical to SEQ ID NO: 536943
  misc_feature: HIJSMM301DYQMD.19.86.H09.1.454.light.4.raw

SEQ ID NO: 586236 - DNA, 486 bp, Homo sapiens; identical to SEQ ID NO: 535043
  misc_feature: HIJSMM301DMP2M.46.35.D02.1.454.light.4.raw

SEQ ID NO: 586237 - DNA, 508 bp, Homo sapiens
  misc_feature: HIJSMM301B6XLF.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtcctaagtcagcccaaggctgcccctcggtcactctgtt

SEQ ID NO: 586238 - DNA, 497 bp, Homo sapiens; identical to SEQ ID NO: 536371
  misc_feature: HIJSMM301A2UYS.16.78.H01.1.454.light.4.raw

SEQ ID NO: 586239 - DNA, 495 bp, Homo sapiens
  misc_feature: HIJSMM301CXML9.9.1.A01.1.454.light.4.raw
  modified_base (462)..(462): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacgacgactggagataagtaaacngtggctgcaccatctgtcttctatccttccccg

SEQ ID NO: 586240 - DNA, 445 bp, Homo sapiens; identical to SEQ ID NO: 551271
  misc_feature: HIJSMM301EVIP0.5.9.A09.1.454.light.4.raw

SEQ ID NO: 586241 - DNA, 487 bp, Homo sapiens; identical to SEQ ID NO: 540237
  misc_feature: HIJSMM301C7IGJ.47.67.G01.1.454.light.4.raw

SEQ ID NO: 586242 - DNA, 474 bp, Homo sapiens; identical to SEQ ID NO: 552986
  misc_feature: HIJSMM301BWA6E.3.38.D05.1.454.light.4.raw

SEQ ID NO: 586243 - DNA, 497 bp, Homo sapiens
  misc_feature: HIJSMM301BOCI6.16.78.H01.1.454.light.4.raw
tgtactactccacgaccggtgctcgatttagtgtgagtagtttgggtttgggggaggaacgtgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagtattttgcggtttattactgtcagcagtataataactggcctcacggtacacgtttggccagggaccaagctggagatcaaacgaactgtggctgcaccatctgtt

SEQ ID NO: 586244 - DNA, 517 bp, Homo sapiens
  misc_feature: HIJSMM301BRV5D.15.57.F02.1.454.light.4.raw
tctacgtagccacgaccggtgctcgatttagctcgatatagttgggtttggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctcgccccctcggtcactcttcg

SEQ ID NO: 586245 - DNA, 508 bp, Homo sapiens
  misc_feature: HIJSMM301BI2PX.15.66.F11.1.454.light.4.raw
tctacgtagccacgaccggtgctcgatttagtcacgcgagaagggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccattggtgattataactatgtctcctggtaccagcagcacccaggcaaagcccccaaagtcatcatttatgagctcactaagcggccctcaggggtccctgatcgcttctctggctccaagtctggcgactcggcctccctgaccgtctctgggctccagcctgaagatgaggctgattatttctgcggctcatatggagacaattacagctttgtcttcggaagtgggaccaaggtcaccgtcctaagtcagcccaaggccaacccactgtcactctgttcccccctcctccg

SEQ ID NO: 586246 - DNA, 486 bp, Homo sapiens
  misc_feature: HIJSMM301AKA6D.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgcccctcctccactactcgtactgacggcgggcgtcggacgaacgggccgactaagta

SEQ ID NO: 586247 - DNA, 482 bp, Homo sapiens
  misc_feature: HIJSMM301AM2B6.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggaccaaggtggagatcaacgaa

SEQ ID NO: 586248 - DNA, 494 bp, Homo sapiens
  misc_feature: HIJSMM301D2YOU.48.1.A01.1.454.light.4.raw
  modified_base (465)..(465): a, c, t, g, unknown or other
agtatacatacacgaccggtgctcgatttagacgtctcatcagggggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactntggctgcaccatctgtcttcatcttcccg

SEQ ID NO: 586249 - DNA, 499 bp, Homo sapiens
  misc_feature: HIJSMM301EQJIQ.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaaccca

SEQ ID NO: 586250 - DNA, 512 bp, Homo sapiens
  misc_feature: HIJSMM301AQ2ES.40.53.E09.1.454.light.4.raw
tctagcgactcacgaccggtgctcgatttagagagagtgtgttgggtttgggggggtagagaagacaggactcaggacaatctccagcatggccagcttccctctcctcctcaccctcctcactcactgtgcagggtcctgggcccagtctgtgctgactcagccaccctcagcgtctgggacccccggtcagagggtcaccatctcttgttctggaagcagatccaacatcggaagtaatactgtaaactggtaccagcagctcccaggaacggcccccaaactcctcatctatgataatagtcaccggccctcaggggtacctgaccgattctctggctccaagtctggcacctcagcctccctggccatcagtgggctccagtctgaggatgaggctgattatcactgtgcatcctgggatgacagcctgaatggttgggtggttcgggcgggggaccgaagctgaccgtcctaagtcagcccaaggctgccccctcggtcactcttcg

SEQ ID NO: 586251 - DNA, 489 bp, Homo sapiens; identical to SEQ ID NO: 538618
  misc_feature: HIJSMM301EOM9K.12.88.H11.1.454.light.4.raw

SEQ ID NO: 586252 - DNA, 499 bp, Homo sapiens; identical to SEQ ID NO: 543588
  misc_feature: HIJSMM301CHF89.19.78.H01.1.454.light.4.raw

SEQ ID NO: 586253 - DNA, 494 bp, Homo sapiens; identical to SEQ ID NO: 543247
  misc_feature: HIJSMM301D0WCP.22.57.F02.1.454.light.4.raw

SEQ ID NO: 586254 - DNA, 444 bp, Homo sapiens; identical to SEQ ID NO: 535594
  misc_feature: HIJSMM301B4L7A.9.9.A09.1.454.light.4.raw

SEQ ID NO: 586255 - DNA, 489 bp, Homo sapiens; identical to SEQ ID NO: 536663
  misc_feature: HIJSMM301CDRBR.16.72.G06.1.454.light.4.raw

SEQ ID NO: 586256 - DNA, 503 bp, Homo sapiens; identical to SEQ ID NO: 538884
  misc_feature: HIJSMM301CJRK4.27.78.H01.1.454.light.4.raw

SEQ ID NO: 586257 - DNA, 501 bp, Homo sapiens; identical to SEQ ID NO: 535746
  misc_feature: HIJSMM301A0AH8.18.11.A11.1.454.light.4.raw

SEQ ID NO: 586258 - DNA, 496 bp, Homo sapiens
  misc_feature: HIJSMM301CDR4F.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccagtcaccctgtctttgtctccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactgtggctgcaccatctgtcttcatt

SEQ ID NO: 586259 - DNA, 480 bp, Homo sapiens
  misc_feature: HIJSMM301A2T6O.48.45.E01.1.454.light.4.raw
agtatacatacacgaccggtgctcgatttagtgagtcagtaagggaaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgctaatacctatgtctcctggtaccaacaacacgcaggcaaagcccccaaactcatgatttatgatgtcactaagcggccctcaggggtccctgctcgcttctctggctccaagtctggcaacacggcctccctgaccatctctgggctccaggctgaagatgaggctgattatttctgctgctcatatgcagccaactattatgtcttcggaactgagaccaaggtcaccgtcctaggtcag

SEQ ID NO: 586260 - DNA, 513 bp, Homo sapiens
  misc_feature: HIJSMM301EB4KO.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgccctccct

SEQ ID NO: 586261 - DNA, 490 bp, Homo sapiens; identical to SEQ ID NO: 535234
  misc_feature: HIJSMM301CT3SP.17.21.B10.1.454.light.4.raw

SEQ ID NO: 586262 - DNA, 490 bp, Homo sapiens
  misc_feature: HIJSMM301AIVGW.26.23.C01.1.454.light.4.raw
agactatactcacgaccggtgctcgatttagtacacgtgattagggattgggggagtcagacccagtcaggacacagcatggacatgagggtccccgctcagctcctggggctcctgctgctctggctcccaggtgtcaaatgtgacatccagatgacccagtctccttccaggctgtctgcatctgtcggagacagagtcaccatcacttgccgggccagtcagagtattggtaggtggttggcctggtatcagcagaaaccaggaacaatccctaagatcctaatctctcaggcgtctggtttggaaagtggggtcccatcaaggttcagtggcgccggatctgggacagaattcactctcaccatcagcgggctccagtctgaggactctgcaacttattactgccaacaatatgatatttattctccagcgttcggccaggggaccaaggtggaagtacaagacgaactgtggctgcaccatctgt

SEQ ID NO: 586263 - DNA, 516 bp, Homo sapiens
  misc_feature: HIJSMM301A9VJK.48.14.B03.1.454.light.4.raw
agtatacatacacgaccggtgctcgatttagtgtgagtagttccgcggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccgaagggaccgggtgggaaataaaacgaactgtggctgcaccatctgtcttcatcttccccg

SEQ ID NO: 586264 - DNA, 497 bp, Homo sapiens
  misc_feature: HIJSMM301CHSLD.13.6.A06.1.454.light.4.raw
tcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcattatttatgatttcactaagcgaccctcaggggtccctgatcgcttctctggctccaagtctggcaacacggcctccctgaccatctctgggctccaggctgacgatgaggctgagtattcctgctgctcatctggaggcacctactctttaatattcggcggagggacccagctgaccgtcctaggtcagcccaaggctcgccccctcggtcactctgttcccaccctcctctacg

SEQ ID NO: 586265 - DNA, 488 bp, Homo sapiens
  misc_feature: HIJSMM301ELDZQ.48.35.D02.1.454.light.4.raw
agtatacatacacgaccggtgctcgatttagcacacgatagttgggtttgggggtagctcaggaagcagagcctggagcatctccactatggcctgggctccactacttctcaccctcctcgctcactgcacaggttcttgggcccattttatgctgactcagccccactctgtgtcggagtctccggggaagacggtgaccatctcctgcacccgcagcagtggcagcgttgccaccaactatgtgcagtggttccagcagcgcccgggcagttcgcccatcactgtgatctatgagaataatgagagaccctctggggtccccgatcggttctctggctccatcgacaggtcctccaactctgcctctctcaccatctctggactgcagactgaggacgaggctgattactactgtcagtcttatgatagtggcaataatgtttgggtgtttggcggagggaccaagctgaccgtcctaggtcacg

SEQ ID NO: 586266 - DNA, 463 bp, Homo sapiens; identical to SEQ ID NO: 535062
  misc_feature: HIJSMM301ARKJV.11.73.G07.1.454.light.4.raw

SEQ ID NO: 586267 - DNA, 463 bp, Homo sapiens; identical to SEQ ID NO: 535062
  misc_feature: HIJSMM301D363G.11.73.G07.1.454.light.4.raw

SEQ ID NO: 586268 - DNA, 501 bp, Homo sapiens; identical to SEQ ID NO: 535746
  misc_feature: HIJSMM301D0PQ0.18.11.A11.1.454.light.4.raw

SEQ ID NO: 586269 - DNA, 481 bp, Homo sapiens
  misc_feature: HIJSMM301D6RIW.13.8.A08.1.454.light.4.raw
tcacgtactacacgaccggtgctcgatttagcatactctacaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccgtcacttgccgggcaagtcagaccattgacaaatatgtaaattggtatcaacagaagccaggtgaagcccctaagctcctgatctatactgcatccactttgtcaggcggggtcccatcaaggttccgtggcagtggatctgggacagatttcactctcaccatcaccagtctgcaacctgaagactgtgcaacttacactgccaacagtcttacggaacctcgtacacttttggccaggggccaggctggagatcaaacgaactgtggctgcaccatctgtt

SEQ ID NO: 586270 - DNA, 474 bp, Homo sapiens; identical to SEQ ID NO: 548202
  misc_feature: HIJSMM301BJ6V3.3.1.A01.1.454.light.4.raw

SEQ ID NO: 586271 - DNA, 508 bp, Homo sapiens
  misc_feature: HIJSMM301A5KE9.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactcttcg

SEQ ID NO: 586272 - DNA, 504 bp, Homo sapiens; identical to SEQ ID NO: 549053
  misc_feature: HIJSMM301DVN5A.4.71.G05.1.454.light.4.raw

SEQ ID NO: 586273 - DNA, 491 bp, Homo sapiens
  misc_feature: HIJSMM301EBURX.49.57.F02.1.454.light.4.raw
agtcgagagacacgaccggtgctcgatttagctcgatatagttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccagggaccaagctggaaatcagacgaactgtggctgcaccat

SEQ ID NO: 586274 - DNA, 477 bp, Homo sapiens; identical to SEQ ID NO: 543928
  misc_feature: HIJSMM301DZM90.16.86.H09.1.454.light.4.raw

SEQ ID NO: 586275 - DNA, 513 bp, Homo sapiens
  misc_feature: HIJSMM301DL5KC.17.33.C11.1.454.light.4.raw
  modified_base (463)..(463): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggaggaccaagctgaccgtnttaagtcagcccaaggctgccccctcggtcactctcgttcccaccctcct

SEQ ID NO: 586276 - DNA, 518 bp, Homo sapiens; identical to SEQ ID NO: 545665
  misc_feature: HIJSMM301BOYMA.8.87.H10.1.454.light.4.raw

SEQ ID NO: 586277 - DNA, 521 bp, Homo sapiens
  misc_feature: HIJSMM301AGDSB.13.4.A04.1.454.light.4.raw
tcacgtactacacgaccggtgctcgatttagagtagtgatcagggggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcaggcccaaggcccaacccccactcgtcactctcgttcccccg

SEQ ID NO: 586278 - DNA, 495 bp, Homo sapiens
  misc_feature: HIJSMM301EE55U.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcgccaagggaccgaaagtaggacgatcaagacgaactagtggctgcaccactctgtt

SEQ ID NO: 586279 - DNA, 492 bp, Homo sapiens; identical to SEQ ID NO: 535126
  misc_feature: HIJSMM301EV3CI.18.11.A11.1.454.light.4.raw

SEQ ID NO: 586280 - DNA, 503 bp, Homo sapiens; identical to SEQ ID NO: 582321
  misc_feature: HIJSMM301B2K0Y.21.22.B11.1.454.light.4.raw

SEQ ID NO: 586281 - DNA, 506 bp, Homo sapiens
  misc_feature: HIJSMM301AGFR7.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaaggtggaagtcaagcgactgtggctgcaccatctgtcttcatcttcccgcc

SEQ ID NO: 586282 - DNA, 487 bp, Homo sapiens
  misc_feature: HIJSMM301CRC01.40.83.H06.1.454.light.4.raw
tctagcgactcacgaccggtgctcgatttagatcacgtgcgtcgcggggtccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactgtccgtcctaggtcagaccccg

SEQ ID NO: 586283 - DNA, 500 bp, Homo sapiens
  misc_feature: HIJSMM301EVTOF.19.78.H01.1.454.light.4.raw
tactctcgtgcacgaccggtgctcgatttagtgtgagtagtttgggtttggggctttatttgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttccccgccctcctcccacgagagta

SEQ ID NO: 586284 - DNA, 496 bp, Homo sapiens; identical to SEQ ID NO: 548177
  misc_feature: HIJSMM301D18V5.18.59.F04.1.454.light.4.raw

SEQ ID NO: 586285 - DNA, 494 bp, Homo sapiens; identical to SEQ ID NO: 534994
  misc_feature: HIJSMM301ECL44.27.78.H01.1.454.light.4.raw

SEQ ID NO: 586286 - DNA, 489 bp, Homo sapiens
  misc_feature: HIJSMM301ED0Q1.43.36.D03.1.454.light.4.raw
  modified_base (441)..(441): a, c, t, g, unknown or other
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaatattttagngctccgtacacttttggccagggggaccaaggttggagatcaaacgaa

SEQ ID NO: 586287 - DNA, 519 bp, Homo sapiens
  misc_feature: HIJSMM301C6I7N.48.59.F04.1.454.light.4.raw
agtatacatacacgaccggtgctcgatttagtacacacacttagggattggggagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctggtcactctgttcccaccctcctcta

SEQ ID NO: 586288 - DNA, 506 bp, Homo sapiens
  misc_feature: HIJSMM301D63Q6.40.53.E09.1.454.light.4.raw
tctagcgactcacgaccggtgctcgatttagagagagtgtgttgggtttgggggaagagcttctcagttaggacccagagggaaccatggaaaccccagcgcagcttctcttcctcctgctactctggctcccagatgccaccggagaaattgtgttgacgcagtctccaggtaccctgtctttgtctccaggggaaagagccaccctctcctgcagggccagtcagagtattaggaacactgtccaaggctggtatcagcataaacctggccaggctcccaggctcctcatctatgagacgtccaggagggccagtggcatcccagacaggttcagtggcagtgggtctgggaccgacttcactctaaccatcagtagactggaacctgaagactctgcagtgtattactgtcaacactttgaaggcccacttatcacattcggcggagggaccaaggtggagatcaagcgaactgtggctgcaccatctgtcttcatcttcccg

SEQ ID NO: 586289 - DNA, 499 bp, Homo sapiens; identical to SEQ ID NO: 543887
  misc_feature: HIJSMM301AUXZO.10.65.F10.1.454.light.4.raw

SEQ ID NO: 586290 - DNA, 498 bp, Homo sapiens; identical to SEQ ID NO: 537020
  misc_feature: HIJSMM301D9PTN.26.26.C04.1.454.light.4.raw

SEQ ID NO: 586291 - DNA, 507 bp, Homo sapiens; identical to SEQ ID NO: 561702
  misc_feature: HIJSMM301EY24A.5.24.C02.1.454.light.4.raw

SEQ ID NO: 586292 - DNA, 513 bp, Homo sapiens
  misc_feature: HIJSMM301BTTBX.16.85.H08.1.454.light.4.raw
tgtactactccacgaccggtgctcgatttagtatcactcagtcgcgggctgggcctaaggaagcagcactggtggtgcctcagccatggcctggaccgttctcctcctcggcctcctctctcactgcacaggctctgtgacctcctatgtgctgactcagccaccctcggtgtcgttggccccaggacagacggccttaataacctgtgggggaagcaacattggaagcaaaaatgtgcactggtacatgcagaggccaggccaggcccctgttttggtcgtctatgatgataccgagcggccctcagggatccctgagcgattctccggctccaactctggtgacacggccaccctgaccatcaacagggtcgaagtcggggatgaggccgactattactgtcaggtgtgggatggtgttagtgatcgggcacttttcggcggagggacccagctgaccgtcctaggtcagcccaaggctgccccctcggtcactctgtcccgccctcctcg

SEQ ID NO: 586293 - DNA, 507 bp, Homo sapiens; identical to SEQ ID NO: 563344
  misc_feature: HIJSMM301C8XDU.3.79.H02.1.454.light.4.raw

SEQ ID NO: 586294 - DNA, 518 bp, Homo sapiens
  misc_feature: HIJSMM301C5KYD.40.87.H10.1.454.light.4.raw
tctagcgactcacgaccggtgctcgatttagcagtactgcgttgggtttggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatttcttgttctggaagcaactccaatatcggaactaattatgtatactggtaccagcagctcccaggaacggcccccaaagtcctcttctataggaataatcaacggccctcaggggtccctgaccgattctctgcctccaagtctggcacctctgtgtccctggccatcagtgggctccggtccgaagatgagggtgactattactgtgcagcttgggatgagagcctgagaggttggctgttcggcggagggaccaaggctgaccgtcctaggtcagcccaaggctgccccctcggtcactc

SEQ ID NO: 586295 - DNA, 499 bp, Homo sapiens; identical to SEQ ID NO: 537800
  misc_feature: HIJSMM301CW746.22.38.D05.1.454.light.4.raw

SEQ ID NO: 586296 - DNA, 489 bp, Homo sapiens; identical to SEQ ID NO: 562293
  misc_feature: HIJSMM301BOU34.3.10.A10.1.454.light.4.raw

SEQ ID NO: 586297 - DNA, 505 bp, Homo sapiens
  misc_feature: HIJSMM301A8AZP.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccgttcactttcggcggagggaccaaggtggacctcaaacgaactgtggctgcaccatctgtcttcatcttcccgccat

SEQ ID NO: 586298 - DNA, 444 bp, Homo sapiens; identical to SEQ ID NO: 534993
  misc_feature: HIJSMM301DRVTL.5.9.A09.1.454.light.4.raw

SEQ ID NO: 586299 - DNA, 464 bp, Homo sapiens; identical to SEQ ID NO: 536640
  misc_feature: HIJSMM301A29ON.26.78.H01.1.454.light.4.raw

SEQ ID NO: 586300 - DNA, 487 bp, Homo sapiens
  misc_feature: HIJSMM301CF891.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccgaaaactgaccgtcctaggtcagcccaaggctgccccctcggtcactctgttcccaccctcctctacgtgagct

SEQ ID NO: 586301 - DNA, 484 bp, Homo sapiens; identical to SEQ ID NO: 577957
  misc_feature: HIJSMM301A14N9.49.57.F02.1.454.light.4.raw

SEQ ID NO: 586302 - DNA, 499 bp, Homo sapiens; identical to SEQ ID NO: 537739
  misc_feature: HIJSMM301A8HW3.12.86.H09.1.454.light.4.raw

SEQ ID NO: 586303 - DNA, 500 bp, Homo sapiens; identical to SEQ ID NO: 540219
  misc_feature: HIJSMM301C92G4.43.34.D01.1.454.light.4.raw

SEQ ID NO: 586304 - DNA, 473 bp, Homo sapiens; identical to SEQ ID NO: 536488
  misc_feature: HIJSMM301DKO0S.12.49.E05.1.454.light.4.raw

SEQ ID NO: 586305 - DNA, 486 bp, Homo sapiens
  misc_feature: HIJSMM301ASTB7.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgagattttgcagtctattactgtcagcagtatagttactggagaaccttcggccaagggacacgactggagattaaaggaactgtgg

SEQ ID NO: 586306 - DNA, 509 bp, Homo sapiens
  misc_feature: HIJSMM301BMI4L.53.71.G05.1.454.light.4.raw
cgcgtatacacacgaccggtgctcgatttagtgtcgtcgcaagagagagggggagtctgggcctaaggaagcagcactggtggtgcctcagccatggcctggaccgttctcctcctcggcctcctctctcactgcacaggctctgtgacctcctatctattgactcagccaccctcggtgtcagtggccccaggaaggacggccacgatgacctgtgcaggaaacaacattggaagtaaaagtgtgcactggtaccagcacaggccaggccaggcccctgcgctggtcgtctatgatgatagcgaccggccctcagggatccctgagcgattctctggctccaactctggggacacggccaccctgaccatcagcagggtcgaagccggagacgaggccgactattactgtcaggtgtgggattttaatagtgatcattgggtgttcggcggagggaccaagctgaccgtcctaggtcagcccaaggctgccccctcggtcactctccg

SEQ ID NO: 586307 - DNA, 492 bp, Homo sapiens
  misc_feature: HIJSMM301AGAF1.12.12.B01.1.454.light.4.raw
atacgacgtacacgaccggtgctcgatttagtagtgtagattccgcggggacagcgaccatgttctgagggtcagactcaaacagcatcacccaggacaccgacaggagccggggcacaatgagagcctcacctgggaaatgcagccggaggcacctgggcccagatgtcagcctgggcagctcccacagtgctggaattccctggaagatgccccaaggttgagtctctgaggcctcctatgagctgacacagccaccctcggtgtcagtgtccccaggacaaacggccaggatcacctgctctggagctgcattgccaataaaatctccttattggtaccagcagaagtcaggccaggcccctgtattggtcatctatgaggacaacagacgaccttccgggatccctgagagattctctggctccacctcagggacaatggccaccttgactatcagtggcgcccacggtggaggatgaggctgactac

SEQ ID NO: 586308 - DNA, 480 bp, Homo sapiens
  misc_feature: HIJSMM301CLN93.41.68.G02.1.454.light.4.raw
tctatactatcacgaccggtgctcgatttagtcgatagtgaagggaaagggggaggtcagtcccaacccaggacacagcatggacatgagggtccctgctcagctcctggggctcctgctgctctggctctcaggtgccagatgtgacatccagatgacccagtctccaacctccctgtctgcatctgtaggagacagagtcaccatcacttgtcaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggaggaccaggtggagatcaaacgaactgtggctgcac

SEQ ID NO: 586309 - DNA, 508 bp, Homo sapiens
  misc_feature: HIJSMM301CT1TJ.16.46.E02.1.454.light.4.raw
tgtactactccacgaccggtgctcgatttagactcatctacagggaaaggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatactttgtcttcggaactgggaccaaggtcaccgtcctaggtcagcccaaggccaacccactgtcactctcg

SEQ ID NO: 586310 - DNA, 486 bp, Homo sapiens; identical to SEQ ID NO: 535043
  misc_feature: HIJSMM301DYZEH.46.35.D02.1.454.light.4.raw

SEQ ID NO: 586311 - DNA, 515 bp, Homo sapiens
  misc_feature: HIJSMM301EOJ6R.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtggaaagtacaaacgaaacctagtggcgtgcgaccactctgtcttctacttccttccccg

SEQ ID NO: 586312 - DNA, 320 bp, Homo sapiens
  misc_feature: HIJSMM301EF6O0.41.37.D04.1.454.light.4.raw
tctatactatcacgaccggtgctcgatttagtagcatactgttgggtttgggggaggaactgctcagttaggacccagacggaaccatggaagccccagcgcagcttctcttcctcctgctactctggctcccagataccactggagaaatagtgatgacgcagtctccagacaccctgtctgtgtctccgaggggaaagagccaccctctcctgcagggccagtcagagtgtcaccaacaagttggcctggtaccagcagaaatctggaactgtggctgcaccatctgtcttcatcttcccgcatctgaatagtataga

SEQ ID NO: 586313 - DNA, 487 bp, Homo sapiens
  misc_feature: HIJSMM301APX1W.41.33.C11.1.454.light.4.raw
tctatactatcacgaccggtgctcgatttagagtgagctcgttgggtttggggaggaactgctcagttaggacccagacggaaccatggaagccccagcgcagcttctcttcctcctgctactctggctcccagataccactgcagaaatactgatgacgcagtctccagccaccctgtctgtgtctccaggagaaagagtcaccctctcctgcagggccagtcagagtgctggcagcaacttagcctggtatcagcagaaacctggccaggctcccaggctcctcatctctggtgcttccacccgggacactggtatcccagccaggttcagtggcagtgggtctgggacagagttcactctcaccatcagcactctacagtctgaggattatgcagtttactactgtctgcagtataaagactggcctagggtcactttcggccctgggaccaaggtggagatcaaacgaactagtggctgcacc

SEQ ID NO: 586314 - DNA, 503 bp, Homo sapiens; identical to SEQ ID NO: 537189
  misc_feature: HIJSMM301DPQY6.19.85.H08.1.454.light.4.raw

SEQ ID NO: 586315 - DNA, 506 bp, Homo sapiens
  misc_feature: HIJSMM301EC284.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaacgtggatatcaaacgaaactgtggctgcaccatctgtt

SEQ ID NO: 586316 - DNA, 479 bp, Homo sapiens; identical to SEQ ID NO: 537163
  misc_feature: HIJSMM301EPFUF.13.73.G07.1.454.light.4.raw

SEQ ID NO: 586317 - DNA, 490 bp, Homo sapiens; identical to SEQ ID NO: 535234
  misc_feature: HIJSMM301BOSVW.17.21.B10.1.454.light.4.raw

SEQ ID NO: 586318 - DNA, 488 bp, Homo sapiens; identical to SEQ ID NO: 541295
  misc_feature: HIJSMM301DKHYN.9.59.F04.1.454.light.4.raw

SEQ ID NO: 586319 - DNA, 504 bp, Homo sapiens; identical to SEQ ID NO: 538940
  misc_feature: HIJSMM301DYJB9.2.35.D02.1.454.light.4.raw

SEQ ID NO: 586320 - DNA, 470 bp, Homo sapiens; identical to SEQ ID NO: 548577
  misc_feature: HIJSMM301BCZ4L.48.49.E05.1.454.light.4.raw

SEQ ID NO: 586321 - DNA, 504 bp, Homo sapiens
  misc_feature: HIJSMM301B7HDK.18.78.H01.1.454.light.4.raw
tacgagtatgcacgaccggtgctcgatttagtgtgagtagtttgggtttgggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcacgtcctaggtcagccaaggccaaccccactgt

SEQ ID NO: 586322 - DNA, 486 bp, Homo sapiens; identical to SEQ ID NO: 550554
  misc_feature: HIJSMM301D6QG6.3.55.E11.1.454.light.4.raw

SEQ ID NO: 586323 - DNA, 504 bp, Homo sapiens
  misc_feature: HIJSMM301CPRA8.9.71.G05.1.454.light.4.raw
tgatacgtctcacgaccggtgctcgatttagtgtcgtcgcaagagagaggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggcctcgcccccc

SEQ ID NO: 586324 - DNA, 485 bp, Homo sapiens
  misc_feature: HIJSMM301DLLQM.4.29.C07.1.454.light.4.raw
agcactgtagcacgaccggtgctcgatttagagtgctacgaagggaaagggggaagagctgctcagttaggacccagagggaaccatggaaaccccagcgcagcttctcttcctcctgctactctggctccctgatgccaccggagaaattgtgttgacgcagtctccagccaccctgtctttgtctccaggggaaagagccaccctctcctgcagggccagtcagaatgttagcagcagattcttagcctggtatcagcagagacgtggccaggctcccaggctcatcatctatggtgcatccagcagggccactggcatcccagacaggttcagtggcagtgggtctgggacagacttcactctcaccatcagcgacctggagcctgaagattttgcagtgtattactgtcagcagtatggtagcgcacggacgttcggccgaagggccgagggtggaaatcaaacgaactgtggctgcacca

SEQ ID NO: 586325 - DNA, 482 bp, Homo sapiens; identical to SEQ ID NO: 567744
  misc_feature: HIJSMM301EKA8O.41.47.E03.1.454.light.4.raw

SEQ ID NO: 586326 - DNA, 496 bp, Homo sapiens; identical to SEQ ID NO: 536063
  misc_feature: HIJSMM301CELX1.5.49.E05.1.454.light.4.raw

SEQ ID NO: 586327 - DNA, 498 bp, Homo sapiens; identical to SEQ ID NO: 535469
  misc_feature: HIJSMM301C4K2Q.12.18.B07.1.454.light.4.raw

SEQ ID NO: 586328 - DNA, 491 bp, Homo sapiens; identical to SEQ ID NO: 535294
  misc_feature: HIJSMM301BM7L7.16.68.G02.1.454.light.4.raw

SEQ ID NO: 586329 - DNA, 489 bp, Homo sapiens; identical to SEQ ID NO: 557621
  misc_feature: HIJSMM301AT1NM.13.87.H10.1.454.light.4.raw

SEQ ID NO: 586330 - DNA, 486 bp, Homo sapiens; identical to SEQ ID NO: 535043
  misc_feature: HIJSMM301AJAN3.46.35.D02.1.454.light.4.raw

SEQ ID NO: 586331 - DNA, 516 bp, Homo sapiens; identical to SEQ ID NO: 538293
  misc_feature: HIJSMM301D83S5.14.19.B08.1.454.light.4.raw

SEQ ID NO: 586332 - DNA, 505 bp, Homo sapiens; identical to SEQ ID NO: 539292
  misc_feature: HIJSMM301EDRCZ.19.85.H08.1.454.light.4.raw

SEQ ID NO: 586333 - DNA, 497 bp, Homo sapiens; identical to SEQ ID NO: 536376
  misc_feature: HIJSMM301AJLWT.22.9.A09.1.454.light.4.raw

SEQ ID NO: 586334 - DNA, 422 bp, Homo sapiens
  misc_feature: HIJSMM301CIVJH.41.12.B01.1.454.light.4.raw
tctatactatcacgaccggtgctcgatttagtagtgtagattccgcgggcacgaccggtgctcgatttagtctagcgactttgggtttgggggaaagagccaccctctcctgcagggccagtgagacagttactgtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 586335 - DNA, 487 bp, Homo sapiens
  misc_feature: HIJSMM301CP90W.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatagtcagacgaa

SEQ ID NO: 586336 - DNA, 496 bp, Homo sapiens; identical to SEQ ID NO: 536802
  misc_feature: HIJSMM301B2E2C.5.24.C02.1.454.light.4.raw

SEQ ID NO: 586337 - DNA, 496 bp, Homo sapiens; identical to SEQ ID NO: 537925
  misc_feature: HIJSMM301EC7GF.22.14.B03.1.454.light.4.raw

SEQ ID NO: 586338 - DNA, 511 bp, Homo sapiens; identical to SEQ ID NO: 550438
  misc_feature: HIJSMM301DKFBB.17.33.C11.1.454.light.4.raw

SEQ ID NO: 586339 - DNA, 497 bp, Homo sapiens
  misc_feature: HIJSMM301AGO3E.16.78.H01.1.454.light.4.raw
tgtactactccacgaccggtgctcgatttagtgtgagtagtttgggtttgggggaggaacgtgctcagttaggacccagacggaaccatggaagccccagcgcagcttctcttcctcctgctactctggctcccagataccactgggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccacagggccactggtatcccagccaggttcagtggcagtgggtctgggacagagttcactctcaccatcagcagcctgcagtctgaagattttgcggtttattactgtcagcagtataataactggcctccacggtacactttggccagggaccaagctggagatcaaacgaactgtcggctgcaccatctgtt

SEQ ID NO: 586340 - DNA, 422 bp, Homo sapiens
  misc_feature: HIJSMM301DCXXA.9.25.C03.1.454.light.4.raw
tgatacgtctcacgaccggtgctcgatttagtagtgtagatttgggtttgggaacctatgaacattctgtcagtggcccctggaaagacggccagcataacctgtgagggagacaacattaaaacaaataatgtgcattggtaccagcagaagccaggccaggcccctgtcctggtcgtctttgatgatagtgaccggccctcagggatccctgagcgattctctggctccaactctgggaacacggccaccctgaccatcagcggggtcgaagccggggatgaggccgactatttctgtcagctgtgggattctcatgatggtagtgggggaatcttcggcggagggaccaggctgaccgtcctaagtcagcccaaggctgcccctcggtcactctgttcccgccctcctcagacgtatca

SEQ ID NO: 586341 - DNA, 501 bp, Homo sapiens; identical to SEQ ID NO: 535746
  misc_feature: HIJSMM301CLRSE.18.11.A11.1.454.light.4.raw

SEQ ID NO: 586342 - DNA, 495 bp, Homo sapiens
  misc_feature: HIJSMM301DZNLQ.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcactcttccccg

SEQ ID NO: 586343 - DNA, 505 bp, Homo sapiens
  misc_feature: HIJSMM301A5815.9.37.D04.1.454.light.4.raw
tgatacgtctcacgaccggtgctcgatttagtagcatactgttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccacctgatcatcagcagggtcaggtcgaggatgaggccgactattactgtcaggtgtgggatagtggtactgatcattgggtgttcggcgagggaccaagctgaccgtctaggtcagcccaaggctgccccctggtcactctgttcccaccctcctcagacgtatc

SEQ ID NO: 586344 - DNA, 495 bp, Homo sapiens
  misc_feature: HIJSMM301C6QOG.19.78.H01.1.454.light.4.raw
tactctcgtgcacgaccggtgctcgatttagtgtgagtagtttgggtttggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtctaggtcagcccaaggccaaccc

SEQ ID NO: 586345 - DNA, 501 bp, Homo sapiens; identical to SEQ ID NO: 579640
  misc_feature: HIJSMM301CGT4P.9.81.H04.1.454.light.4.raw

SEQ ID NO: 586346 - DNA, 473 bp, Homo sapiens
  misc_feature: HIJSMM301DBGV2.51.40.D07.1.454.light.4.raw
cgatcgtatacacgaccggtgctcgatttagtgatagagcgtaacaacagagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtgaggacattagtaactatttaaattggtatcagcagaaaccaggacaagccctaaactcctgatctacgatgcatccaatttggaaacaggggtcccatcaaggttcagtggaagtggttctgggacagattttactttcaccatcagcagccttcaccctgaagatcttgcaacatattactgtcaacagtatgataatctccactcactttcggcggagggaccaaggtggagatcaaacgaa

SEQ ID NO: 586347 - DNA, 521 bp, Homo sapiens; identical to SEQ ID NO: 538715
  misc_feature: HIJSMM301AQRDT.27.23.C01.1.454.light.4.raw

SEQ ID NO: 586348 - DNA, 496 bp, Homo sapiens
  misc_feature: HIJSMM301CLZTM.49.6.A06.1.454.light.4.raw
agtcgagagacacgaccggtgctcgatttagatctactgacaggggggggtctcagaaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctaatatgcaggcagcaacaatattgtgatattcggcggagggaccaagctgaccgtcctaggtcagccaaggctgccccctc

SEQ ID NO: 586349 - DNA, 502 bp, Homo sapiens
  misc_feature: HIJSMM301BZ0R2.18.11.A11.1.454.light.4.raw
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacacgccccctaaggtcctcatttactgggcatctacccgggagtccggggtccctgaccgattcagaggcagcgggtctgggacagatttcactctcaccatcaccaacctgcaggctgaagatgtggctagtttattactgtcagcaatactatagtcctcctctcacgttcggcggagggaccaaggtggagatcaaacgactgtggctgcaccatctgtctt

SEQ ID NO: 586350 - DNA, 499 bp, Homo sapiens
  misc_feature: HIJSMM301AP4PP.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaacaatgtggcattcggcggagggaccaagctgaccgtcctgggtcagcccaaggctgccccctcggtcactctgttcccgccctcctctgtcgagcgt

SEQ ID NO: 586351 - DNA, 497 bp, Homo sapiens
  misc_feature: HIJSMM301ESBGI.48.60.F05.1.454.light.4.raw
agtatacatacacgaccggtgctcgatttagtacgtcatcagggggcaggagtcagacccagtcaggactcagcatggacatgagggtccccgctcagctcctggggctcctgctgctctggttcccaggttccagatgcgacatccagataacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactgtggctgcaccatctgtcttcatcttcccg

SEQ ID NO: 586352 - DNA, 484 bp, Homo sapiens; identical to SEQ ID NO: 535240
  misc_feature: HIJSMM301DBGCI.47.60.F05.1.454.light.4.raw

SEQ ID NO: 586353 - DNA, 494 bp, Homo sapiens; identical to SEQ ID NO: 536221
  misc_feature: HIJSMM301EEVV5.15.59.F04.1.454.light.4.raw

SEQ ID NO: 586354 - DNA, 490 bp, Homo sapiens
  misc_feature: HIJSMM301CJCWO.3.12.B01.1.454.light.4.raw
agacgcactccacgaccggtgctcgatttagtagtgtagattccgcgggggaggaactgctcagttaggacccagacggaaccatggaagccccagcgcagcttctcttcctcctgctactctggctcccagatgccactggagaaatggggttgacgcagtttccagccaccctgtctgtgtctccgaggggagagagccaccctctcctgcagggccagtcagagtgttgacagcaacttggcctggtaccagcagcaacctggccaggctcccaggctcctcatctatgatgcatccaccagggccaccggtatcccagcccaggttcagtggcagtgggtctgggacagagttcactctcaccatccagcagcctgcagtctgaggattttgctagtttattactgtcagcattacaataactggcctcggctcactttcggcggagggaccaaggtggagatcaaacgaactgtggctgcaccat

SEQ ID NO: 586355 - DNA, 489 bp, Homo sapiens
  misc_feature: HIJSMM301C7AIY.49.35.D02.1.454.light.4.raw
agtcgagagacacgaccggtgctcgatttagcacacgatagttgggtttgggggagctacaacaggcaggcaggggcagcaagatggtgttgcagacccaggtcttcatgtctctgttgctctggatctctggtgcctacggggacatcgtgatgacccagtctccagactccctggctgtgtctctgggcgagagggccaccatcaactgcaggtccagccagagtctttcacgcggcttcaataataagaactacttagcttggtaccagcaaaagccaggacagcctcctgaactgctcatttactgggcatcttcccgggaatccggggtccctgagcgattcagtggcagcgggtctgggacaaatttcactctcaccatcagcagcctgcagactgaagatgtggcagtgtattactgtcagcaatatcacactgctccgctcactttcggcggagggaccagggtggagatcaaacgtaacg

SEQ ID NO: 586356 - DNA, 482 bp, Homo sapiens; identical to SEQ ID NO: 535920
  misc_feature: HIJSMM301CPN0E.19.71.G05.1.454.light.4.raw

SEQ ID NO: 586357 - DNA, 502 bp, Homo sapiens; identical to SEQ ID NO: 541971
  misc_feature: HIJSMM301EGAK6.4.39.D06.1.454.light.4.raw

SEQ ID NO: 586358 - DNA, 495 bp, Homo sapiens
  misc_feature: HIJSMM301EPDSV.41.33.C11.1.454.light.4.raw
tctatactatcacgaccggtgctcgatttagagtgagctcgttgggtttggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaagg

SEQ ID NO: 586359 - DNA, 495 bp, Homo sapiens
  misc_feature: HIJSMM301E0PYV.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcgaatattatagtactcctccgaggctcactttcggcggagggaccaaggtggagatcaaacgaact

SEQ ID NO: 586360 - DNA, 493 bp, Homo sapiens
  misc_feature: HIJSMM301EU3HO.43.87.H10.1.454.light.4.raw
tgtgagtagtcacgaccggtgctcgatttagcagtactgcgttgggtttgggagggtggccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggtcaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagccaaggctgccccctcggtcactctgttcccgccctcctcacta

SEQ ID NO: 586361 - DNA, 493 bp, Homo sapiens; identical to SEQ ID NO: 535657
  misc_feature: HIJSMM301DBSHX.27.78.H01.1.454.light.4.raw

SEQ ID NO: 586362 - DNA, 493 bp, Homo sapiens
  misc_feature: HIJSMM301CETC5.52.71.G05.1.454.light.4.raw
cgcagtacgacacgaccggtgctcgatttagtgtcgtcgcaagagagaggggggaaaaggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagaccccaggccaggctccacgcacgctcatctacagcacaattactcgctcttctggggtccctgatcgcttctctggctccatccttgggaacaagctgccctaaccatcacggggcccaggcagatgatgaatctgattatactgtgtcctctatatgggtagtggcatttggatggttcggcggaggga

SEQ ID NO: 586363 - DNA, 493 bp, Homo sapiens; identical to SEQ ID NO: 535657
  misc_feature: HIJSMM301EK22O.27.78.H01.1.454.light.4.raw

SEQ ID NO: 586364 - DNA, 507 bp, Homo sapiens; identical to SEQ ID NO: 542621
  misc_feature: HIJSMM301DTL3R.4.10.A10.1.454.light.4.raw

SEQ ID NO: 586365 - DNA, 494 bp, Homo sapiens; identical to SEQ ID NO: 535276
  misc_feature: HIJSMM301C6JII.16.6.A06.1.454.light.4.raw

SEQ ID NO: 586366 - DNA, 521 bp, Homo sapiens; identical to SEQ ID NO: 538715
  misc_feature: HIJSMM301B4OP3.27.23.C01.1.454.light.4.raw

SEQ ID NO: 586367 - DNA, 502 bp, Homo sapiens; identical to SEQ ID NO: 540196
  misc_feature: HIJSMM301DQ2DM.40.45.E01.1.454.light.4.raw

SEQ ID NO: 586368 - DNA, 522 bp, Homo sapiens; identical to SEQ ID NO: 543352
  misc_feature: HIJSMM301EGIWL.27.23.C01.1.454.light.4.raw

SEQ ID NO: 586369 - DNA, 491 bp, Homo sapiens; identical to SEQ ID NO: 535194
  misc_feature: HIJSMM301CV4OV.26.78.H01.1.454.light.4.raw

SEQ ID NO: 586370 - DNA, 507 bp, Homo sapiens; identical to SEQ ID NO: 535316
  misc_feature: HIJSMM301AQIJ4.18.37.D04.1.454.light.4.raw

SEQ ID NO: 586371 - DNA, 486 bp, Homo sapiens
  misc_feature: HIJSMM301BEQDP.46.35.D02.1.454.light.4.raw
  modified_base (482)..(482): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcnccat

SEQ ID NO: 586372 - DNA, 494 bp, Homo sapiens; identical to SEQ ID NO: 536974
  misc_feature: HIJSMM301BADAE.16.86.H09.1.454.light.4.raw

SEQ ID NO: 586373 - DNA, 492 bp, Homo sapiens
  misc_feature: HIJSMM301A95YR.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggctagtttattactgtcaacaatattaataataatccatttaatttcggcggagggaccaaggtggagatcaaacgaactgtggctgcacatctgtcttcatcttcccgcta

SEQ ID NO: 586374 - DNA, 494 bp, Homo sapiens; identical to SEQ ID NO: 534994
  misc_feature: HIJSMM301AUL6B.27.78.H01.1.454.light.4.raw

SEQ ID NO: 586375 - DNA, 507 bp, Homo sapiens
  misc_feature: HIJSMM301B3SZ3.2.35.D02.1.454.light.4.raw
acgctcgacacacgaccggtgctcgatttagcacacgatagttgggtttgggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaggcagcagtgacgttggcggttataactatgtctcctggtatcaacaacaccccggcgaagcccccaaactcctcatttatgaggtcactaagcggcccttaggggtccctgatcgcttctctggctccaagtctggcagaacggcctccctgaccgtctctgggctccaagctgaggatgaggctgattattactgcagctcatatgcaggcagcagcaatgtacttttcggcggagggaccaagctgaccgtcctgggtcagcccaaggcctgccccctcggtctacc

SEQ ID NO: 586376 - DNA, 507 bp, Homo sapiens
  misc_feature: HIJSMM301CX9YB.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtccactctcgttcccgcccttccc

SEQ ID NO: 586377 - DNA, 490 bp, Homo sapiens
  misc_feature: HIJSMM301C4Q4V.51.28.C06.1.454.light.4.raw
  modified_base (486)..(486): a, c, t, g, unknown or other
cgatcgtatacacgaccggtgctcgatttagagctcacgtattgggtttggggctgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgcccccncggt

SEQ ID NO: 586378 - DNA, 494 bp, Homo sapiens; identical to SEQ ID NO: 534992
  misc_feature: HIJSMM301AEXYJ.9.1.A01.1.454.light.4.raw

SEQ ID NO: 586379 - DNA, 497 bp, Homo sapiens; identical to SEQ ID NO: 536376
  misc_feature: HIJSMM301AEZV0.22.9.A09.1.454.light.4.raw

SEQ ID NO: 586380 - DNA, 513 bp, Homo sapiens
  misc_feature: HIJSMM301AGT1W.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccgaagggaccgaaggtaggaaatacaaacgaactagtggctgcaccactctgttcttctactcttcccccg

SEQ ID NO: 586381 - DNA, 496 bp, Homo sapiens; identical to SEQ ID NO: 535109
  misc_feature: HIJSMM301BY7IN.16.78.H01.1.454.light.4.raw

SEQ ID NO: 586382 - DNA, 487 bp, Homo sapiens
  misc_feature: HIJSMM301EOF83.49.81.H04.1.454.light.4.raw
agtcgagagacacgaccggtgctcgatttagtagtgtagattcgcggggagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacatatgataatctaccactcactttcggcggtagggaccacggtaggaggatcaaacgaactgtggctgcaccatctgtcttcta

SEQ ID NO: 586383 - DNA, 508 bp, Homo sapiens; identical to SEQ ID NO: 541396
  misc_feature: HIJSMM301AFKTS.17.33.C11.1.454.light.4.raw

SEQ ID NO: 586384 - DNA, 493 bp, Homo sapiens; identical to SEQ ID NO: 559204
  misc_feature: HIJSMM301EBE1T.51.80.H03.1.454.light.4.raw

SEQ ID NO: 586385 - DNA, 512 bp, Homo sapiens
  misc_feature: HIJSMM301CPMP1.17.33.C11.1.454.light.4.raw
  modified_base (506)..(506): a, c, t, g, unknown or other
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccncctcct

SEQ ID NO: 586386 - DNA, 499 bp, Homo sapiens
  misc_feature: HIJSMM301D5TTT.53.81.H04.1.454.light.4.raw
cgcgtatacacacgaccggtgctcgatttagtagtgtagattcgcgggggtgggtccaggaggcagaactctgggtgtctcaccatggcctggatccctctacttctccccctcctcactctctgcacaggctctgaggcctcctatgaggtgacacagccaccctcggtgtcagtgtccccaggacagacggccaggatcacctgctctggagaggcattggcaaaacaatatggatattggtaccggcagaagccaggccaggcccctgtgttggtaatatataaagacagggagaggcccccagggatccctgagcgatactctggctccagctcagggacaacagtcacattgaccatcagtggagtccaggcagaagacgaggctgactattactgtcaatctgcggacagcagtggttctcatgtggtattcggcggagggaccaagctgaccgtcctaggtcagcccaaggctgccccctcggtcactctcg

SEQ ID NO: 586387 - DNA, 474 bp, Homo sapiens; identical to SEQ ID NO: 561309
  misc_feature: HIJSMM301BJU63.5.12.B01.1.454.light.4.raw

SEQ ID NO: 586388 - DNA, 492 bp, Homo sapiens; identical to SEQ ID NO: 540472
  misc_feature: HIJSMM301ALDHS.48.37.D04.1.454.light.4.raw

SEQ ID NO: 586389 - DNA, 497 bp, Homo sapiens; identical to SEQ ID NO: 548712
  misc_feature: HIJSMM301EWNX0.13.10.A10.1.454.light.4.raw

SEQ ID NO: 586390 - DNA, 492 bp, Homo sapiens
  misc_feature: HIJSMM301C9DH9.5.57.F02.1.454.light.4.raw
atcagacacgcacgaccggtgctcgatttagctcgatatagttgggtttgggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccaggaccacagtggatatcaggcgaactgtggctgcaccatctgtctt

SEQ ID NO: 586391 - DNA, 508 bp, Homo sapiens
  misc_feature: HIJSMM301BOBUU.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgccaggacgaacggtaggaatacagacgaactacgtaggctgcgaccactctgtcttctacttcttcccgt

SEQ ID NO: 586392 - DNA, 492 bp, Homo sapiens; identical to SEQ ID NO: 576371
  misc_feature: HIJSMM301BZF8J.43.33.C11.1.454.light.4.raw
  modified_base (361)..(361): a, c, t, g, unknown or other

SEQ ID NO: 586393 - DNA, 467 bp, Homo sapiens
  misc_feature: HIJSMM301D0FB0.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctacgatgcatccaatttggaaacaggggtcccatcaaggttcagtggaagtggatctgggacagattttactttcaccatcagcagcctgcagcctgaagatattgcaacatattactgtcagcagtatgataatctcccgatcaccttcggccaaggacacgaactggagaattaaacgaa

SEQ ID NO: 586394 - DNA, 516 bp, Homo sapiens
  misc_feature: HIJSMM301CJOWZ.49.55.E11.1.454.light.4.raw
agtcgagagacacgaccggtgctcgatttagcactcgcacgttgggtttgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccaatgacgttggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacataaacacttgggtgttcggcggcggggaccaaactgaccgtcctacgtcagcccaaggctgccccctcggtcactctcg

SEQ ID NO: 586395 - DNA, 496 bp, Homo sapiens
  misc_feature: HIJSMM301C0O77.14.55.E11.1.454.light.4.raw
cgtctagtaccacgaccggtgctcgatttagcactcgcacgttgggtttggggagtctcagtcaggacacagcatggacatgagggtccccgctcagctcctgggactcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagtactagtaccccctccacttcgtcggcgggacggaacggacggaggagatagacgaacaagtgtgtgtcacactactctcttctt

SEQ ID NO: 586396 - DNA, 516 bp, Homo sapiens
  misc_feature: HIJSMM301A6TRS.12.85.H08.1.454.light.4.raw
atacgacgtacacgaccggtgctcgatttagtatcactcagtcgcggggggggtctcaggaggcagcgctctcaggacatctccaccatggcctgggctctgctgctcctcaccctcctcactcagggcacagggtcctgggcccaatctgccctgactcagcctgcctccgtgtctgggtctcctggacagtcgatcaccatttcctgcaccggaaccaatagtgacgttggtcgttataactttgtctcctggtacaaacagcacccaggcaaagccccccaactcctgatttatgaggtcactattcggtcctcaggaatttctaatcgcttctctggttccaagtctggcaacacggcctccctgaccatctctggggtccaggctgaggacgaggctgattattactgcagttcatatacaagcacttccactctcgtggtgttcggcggtgggaccaagctgaccgtcctaagtcagcccaaggctgccccctcggtcactctgttccca

SEQ ID NO: 586397 - DNA, 447 bp, Homo sapiens; identical to SEQ ID NO: 535020
  misc_feature: HIJSMM301DXTR4.18.9.A09.1.454.light.4.raw

SEQ ID NO: 586398 - DNA, 489 bp, Homo sapiens; identical to SEQ ID NO: 542780
  misc_feature: HIJSMM301D6EYB.16.53.E09.1.454.light.4.raw

SEQ ID NO: 586399 - DNA, 512 bp, Homo sapiens
  misc_feature: HIJSMM301AOK3B.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgtttcgggactgggaccaaggtcaccgtcctaggtcagcccaaggccaacccactgtcactctcg

SEQ ID NO: 586400 - DNA, 441 bp, Homo sapiens; identical to SEQ ID NO: 534971
  misc_feature: HIJSMM301DE7Z0.11.3.A03.1.454.light.4.raw

SEQ ID NO: 586401 - DNA, 458 bp, Homo sapiens; identical to SEQ ID NO: 546509
  misc_feature: HIJSMM301CQK4K.51.1.A01.1.454.light.4.raw

SEQ ID NO: 586402 - DNA, 495 bp, Homo sapiens; identical to SEQ ID NO: 535596
  misc_feature: HIJSMM301EZEHO.10.79.H02.1.454.light.4.raw

SEQ ID NO: 586403 - DNA, 503 bp, Homo sapiens
  misc_feature: HIJSMM301AMPOE.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctggtcactctgttcccaccctcctcg

SEQ ID NO: 586404 - DNA, 489 bp, Homo sapiens; identical to SEQ ID NO: 535139
  misc_feature: HIJSMM301BTEG4.14.55.E11.1.454.light.4.raw

SEQ ID NO: 586405 - DNA, 447 bp, Homo sapiens
  misc_feature: HIJSMM301BREH3.18.9.A09.1.454.light.4.raw
  modified_base (423)..(423): a, c, t, g, unknown or other
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctnttcccgccctcctccatactcgta

SEQ ID NO: 586406 - DNA, 488 bp, Homo sapiens
  misc_feature: HIJSMM301B7WXT.3.12.B01.1.454.light.4.raw
agacgcactccacgaccggtgctcgatttagtagtgtagattccgtgggggaggaactgctcagttaggacccagacggaaccatggaagccccagcgcagcttctcttcctcctgctactctggctcccagatgccactggagaaatggggttgacgcagtttccagccaccctgtctgtgtctccaggggagagagccaccctctcctgcagggccagtcagagtgttgacagcaacttggcctggtaccagcagcaacctggccaggctcccaggctcctcatctatgatgcatccaccagggccaccggtatcccagccaggttcagtggcagtgggtctgggacagagttcactctcaccatcagcagcctgcagtctgaggattttgctagtttattactgtcagcattacaataactggcctcggctcactttcggcggagggaccaaggtggagatacaaacgaactgtggctgcaccat

SEQ ID NO: 586407 - DNA, 493 bp, Homo sapiens; identical to SEQ ID NO: 537281
  misc_feature: HIJSMM301DHQ8B.9.1.A01.1.454.light.4.raw

SEQ ID NO: 586408 - DNA, 518 bp, Homo sapiens
  misc_feature: HIJSMM301D39JG.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtctaggtcagcccaaggctgccccctcggtcactctgttcccta

SEQ ID NO: 586409 - DNA, 482 bp, Homo sapiens
  misc_feature: HIJSMM301D9KQT.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggatgacgatgaggctgattattattgccagtcctatgacaacaccctgcgtggttttggctgttcggcggcgggaccg

SEQ ID NO: 586410 - DNA, 507 bp, Homo sapiens; identical to SEQ ID NO: 550515
  misc_feature: HIJSMM301DRAJW.12.73.G07.1.454.light.4.raw

SEQ ID NO: 586411 - DNA, 518 bp, Homo sapiens; identical to SEQ ID NO: 543797
  misc_feature: HIJSMM301BY02I.19.80.H03.1.454.light.4.raw

SEQ ID NO: 586412 - DNA, 486 bp, Homo sapiens; identical to SEQ ID NO: 535043
  misc_feature: HIJSMM301EUR5I.46.35.D02.1.454.light.4.raw

SEQ ID NO: 586413 - DNA, 459 bp, Homo sapiens
  misc_feature: HIJSMM301CGGX4.4.39.D06.1.454.light.4.raw
agcactgtagcacgaccggtgctcgatttagtgacatctcgcagttctttggggctcctgctgctctggctcccaggtgccgagggtgacatccagctgacccagtcgccctccaccgtgtctgcatccgtaggagacagagtcaccatcacctgtcgggccagtcagaatatttacagttggttggcctggtatcaccagagaccaggagaagccccaaacctcctcatttatgatgcctccactttgaatggaggggtcccaccaacattcagcggcagtggatctgggacagagttcactctaaccatcagcagcctgcagcctgatgatcttggaacttatttctgccagcaatataatagttattggacgttcggccaggggaccaaggtcgaaatgagacgaactgtggctgcaccatctgtcttcatcttcccgccatctgactacagtgct

SEQ ID NO: 586414 - DNA, 493 bp, Homo sapiens
  misc_feature: HIJSMM301AGTY1.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaacttactactgtcaacagagttacacgtacccccctcactttcggcggagggaccaaggcggagatcagacgaacgtgtggctgcaccatctcgtcttcta

SEQ ID NO: 586415 - DNA, 486 bp, Homo sapiens
  misc_feature: HIJSMM301DF771.13.56.F01.1.454.light.4.raw
tcacgtactacacgaccggtgctcgatttagcagacgtctgaacacgacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgaagattttgcagtttattactgtcagcagtataataactggcctccgtacatgtacacttttggccaggggaccaacctggagat

SEQ ID NO: 586416 - DNA, 512 bp, Homo sapiens; identical to SEQ ID NO: 552150
  misc_feature: HIJSMM301DXMMW.17.33.C11.1.454.light.4.raw

SEQ ID NO: 586417 - DNA, 502 bp, Homo sapiens; identical to SEQ ID NO: 557124
  misc_feature: HIJSMM301DZH7V.10.43.D10.1.454.light.4.raw

SEQ ID NO: 586418 - DNA, 509 bp, Homo sapiens; identical to SEQ ID NO: 541168
  misc_feature: HIJSMM301B7LGN.5.60.F05.1.454.light.4.raw

SEQ ID NO: 586419 - DNA, 463 bp, Homo sapiens
  misc_feature: HIJSMM301DS5TR.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggccagggtggagatcagacgaactgtggctgcaccatctgtcttcatcttcccgccatctgaagtatagtct

SEQ ID NO: 586420 - DNA, 488 bp, Homo sapiens; identical to SEQ ID NO: 541987
  misc_feature: HIJSMM301AD9XH.8.12.B01.1.454.light.4.raw

SEQ ID NO: 586421 - DNA, 463 bp, Homo sapiens; identical to SEQ ID NO: 535062
  misc_feature: HIJSMM301ERYVT.11.73.G07.1.454.light.4.raw

SEQ ID NO: 586422 - DNA, 502 bp, Homo sapiens
  misc_feature: HIJSMM301AW5Y5.18.23.C01.1.454.light.4.raw
tacgagtatgcacgaccggtgctcgatttagtacacgtgattagggattgggggagtcagacccagtcaggacacagcatggacacgaaggtccccgctcagctcctggggctcctgctgctctggctcccaggttccagatgcgacatccagatgacccagtccccttcttccgtgtctgcgtctgtaggagaccgagtcaccatcacttgtcgggcgaatcaggatattaaaacctggttagtttggtatcagcagaaaccaggaaaagcccctaagctgcagatgattggtccgtccagtttccaagatggggccccatcgagattccgcgtcagtggatctgggacagatttcactctcaccatcagcagcctgcagcctgaagattttgcaacttactattgtcagcaggcgcacaatttcccgctcactttcggcggagggaccaaggtggagatcaaacgaactgtggctgcaccatctgtcttcatcttccccg

SEQ ID NO: 586423 - DNA, 486 bp, Homo sapiens; identical to SEQ ID NO: 535385
  misc_feature: HIJSMM301DQAW9.19.71.G05.1.454.light.4.raw

SEQ ID NO: 586424 - DNA, 486 bp, Homo sapiens; identical to SEQ ID NO: 535043
  misc_feature: HIJSMM301CIOUX.46.35.D02.1.454.light.4.raw

SEQ ID NO: 586425 - DNA, 486 bp, Homo sapiens; identical to SEQ ID NO: 538918
  misc_feature: HIJSMM301ERZ42.47.38.D05.1.454.light.4.raw

SEQ ID NO: 586426 - DNA, 489 bp, Homo sapiens
  misc_feature: HIJSMM301DTH2C.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagcatctctggggtccagtttgtggatgaggctgactactattgcacggtctggtacagcagcgctgtggtcttcggcggagggactgaacttatcgtcctaggtcagcccaaggctcg

SEQ ID NO: 586427 - DNA, 499 bp, Homo sapiens
  misc_feature: HIJSMM301A7Q4D.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacagggttcagtggcagtgggtctggggacagacttcactctcaccatccagcagactggagtctgaagattttgcagtgtattattgttcagcaatatggtaggtcacctgggacttttggcctagggaccaagctggagatcaaacgaactgtggctgcaccatctgtctt

SEQ ID NO: 586428 - DNA, 496 bp, Homo sapiens; identical to SEQ ID NO: 553382
  misc_feature: HIJSMM301B73R7.51.59.F04.1.454.light.4.raw

SEQ ID NO: 586429 - DNA, 484 bp, Homo sapiens; identical to SEQ ID NO: 535441
  misc_feature: HIJSMM301CV2Z3.26.60.F05.1.454.light.4.raw

SEQ ID NO: 586430 - DNA, 494 bp, Homo sapiens; identical to SEQ ID NO: 541035
  misc_feature: HIJSMM301B97KJ.26.12.B01.1.454.light.4.raw

SEQ ID NO: 586431 - DNA, 447 bp, Homo sapiens; identical to SEQ ID NO: 535201
  misc_feature: HIJSMM301DV8WT.18.9.A09.1.454.light.4.raw

SEQ ID NO: 586432 - DNA, 484 bp, Homo sapiens; identical to SEQ ID NO: 540581
  misc_feature: HIJSMM301BUJ9R.3.88.H11.1.454.light.4.raw

SEQ ID NO: 586433 - DNA, 497 bp, Homo sapiens; identical to SEQ ID NO: 535664
  misc_feature: HIJSMM301DT55U.22.14.B03.1.454.light.4.raw

SEQ ID NO: 586434 - DNA, 504 bp, Homo sapiens; identical to SEQ ID NO: 539091
  misc_feature: HIJSMM301DJKYK.8.28.C06.1.454.light.4.raw

SEQ ID NO: 586435 - DNA, 511 bp, Homo sapiens
  misc_feature: HIJSMM301CWNQ8.7.34.D01.1.454.light.4.raw
  modified_base (504)..(504): a, c, t, g, unknown or other
cgtgtctctacacgaccggtgctcgatttagatcgtctgtgttgggtttggggggggtcgtcaggaggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgcccccnggtcact

SEQ ID NO: 586436 - DNA, 479 bp, Homo sapiens; identical to SEQ ID NO: 535188
  misc_feature: HIJSMM301D51YJ.10.74.G08.1.454.light.4.raw

SEQ ID NO: 586437 - DNA, 497 bp, Homo sapiens
  misc_feature: HIJSMM301AM8MX.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaggtgtaaatcaaacgaactgtggctgcacca

SEQ ID NO: 586438 - DNA, 481 bp, Homo sapiens; identical to SEQ ID NO: 535993
  misc_feature: HIJSMM301BTCP5.21.25.C03.1.454.light.4.raw

SEQ ID NO: 586439 - DNA, 485 bp, Homo sapiens
  misc_feature: HIJSMM301CJSCG.19.71.G05.1.454.light.4.raw
tactctcgtgcacgaccggtgctcgatttagtgtcgtcgcaagagagagggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttatattgtcaacaatattattatacttcgtggacgttcggccaagggaccaaggtggatatcagacgaa

SEQ ID NO: 586440 - DNA, 523 bp, Homo sapiens
  misc_feature: HIJSMM301BFHKT.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgacccatctccgggctccagcctgaggacgaggctgattattattgtagttcatatacaaccagtgacacttgggtgttcggcggagggaccaggctgaccgtcctaggtcagcccaaggctgccccctcggtcactctcgttcccaccct

SEQ ID NO: 586441 - DNA, 498 bp, Homo sapiens
  misc_feature: HIJSMM301EPOBT.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggaggaccaagctgaccgtcctaggtcagcccaaggctgccccctcggtcact

SEQ ID NO: 586442 - DNA, 500 bp, Homo sapiens; identical to SEQ ID NO: 541872
  misc_feature: HIJSMM301D0S60.48.82.H05.1.454.light.4.raw

SEQ ID NO: 586443 - DNA, 483 bp, Homo sapiens
  misc_feature: HIJSMM301DERJG.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggccaaggtgcagatcaaacgaactgtggctgca

SEQ ID NO: 586444 - DNA, 517 bp, Homo sapiens; identical to SEQ ID NO: 557801
  misc_feature: HIJSMM301EUTX2.40.87.H10.1.454.light.4.raw

SEQ ID NO: 586445 - DNA, 481 bp, Homo sapiens
  misc_feature: HIJSMM301EV0H1.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcgagggaccaaggtggagatcaaacgaactgtggctgcaccat

SEQ ID NO: 586446 - DNA, 510 bp, Homo sapiens
  misc_feature: HIJSMM301DXGQ9.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctcttttggtcgtctatgatgatcgcgaccggcccgcaggggtccctgaacgattctctggcgccagctctcagaacacggccaccctgatcatcaacagggtcgaagtcggggatgaggccgactattactgtcaggtctgggatactgaaattgaatatgtcttcggaactgggaccaaagtcaccgtcctaggtcagcccaacggccaacccactgtcactctgtcccgccctcctctct

SEQ ID NO: 586447 - DNA, 502 bp, Homo sapiens
  misc_feature: HIJSMM301DRTAF.21.81.H04.1.454.light.4.raw
tcgtcgctcgcacgaccggtgctcgatttagtagtgtagattcgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgtttggtctttatgactatgtctcctggtaccaacaatacccaggcaaagccccaaactcatcatttatgatgtcagtaatcggccctcaggggtttctaatcgcttctctggctccaagtctggcaacacggcctccctgaccatctctgggctccaggctgatgacgaggctgattattactgcaggtcatatacaatcagcaacacttatgtcttcgggactgggaccaagatcaccgtcctaggtcagcccaaggccaaccccactgtca

SEQ ID NO: 586448 - DNA, 498 bp, Homo sapiens
  misc_feature: HIJSMM301AF203.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccgaaggtggaatcaaacgaactgtggctgcacc

SEQ ID NO: 586449 - DNA, 507 bp, Homo sapiens
  misc_feature: HIJSMM301BQMYX.47.83.H06.1.454.light.4.raw
agctcacgtacacgaccggtgctcgatttagatcacgtgcgtcgcggggaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaaggctggaccgttcg

SEQ ID NO: 586450 - DNA, 494 bp, Homo sapiens; identical to SEQ ID NO: 557305
  misc_feature: HIJSMM301E34AX.10.79.H02.1.454.light.4.raw

SEQ ID NO: 586451 - DNA, 518 bp, Homo sapiens
  misc_feature: HIJSMM301DJLK7.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatgctccaagtctgcctacacggcctccctgaccatctccgggctccagcctgaggacgaggctgattattattgtagttcatatacaaccagtgacacttgggtgttcggcggagggaccaggctgaccgtcctaggtcagcccaagctgccccctcggtcactctgttccgccct

SEQ ID NO: 586452 - DNA, 501 bp, Homo sapiens
  misc_feature: HIJSMM301CBHHK.48.30.C08.1.454.light.4.raw
agtatacatacacgaccggtgctcgatttagtctgacgtcaaagggaaaggggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttcccg

SEQ ID NO: 586453 - DNA, 493 bp, Homo sapiens; identical to SEQ ID NO: 535084
  misc_feature: HIJSMM301BZEB7.47.64.F09.1.454.light.4.raw

SEQ ID NO: 586454 - DNA, 502 bp, Homo sapiens; identical to SEQ ID NO: 544393
  misc_feature: HIJSMM301CN1GN.19.67.G01.1.454.light.4.raw

SEQ ID NO: 586455 - DNA, 495 bp, Homo sapiens
  misc_feature: HIJSMM301D5LWC.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacctttcggtcggagggaccgaacggacggagatcagacgaactagtggctgcaccatctgtcttcta

SEQ ID NO: 586456 - DNA, 488 bp, Homo sapiens; identical to SEQ ID NO: 535990
  misc_feature: HIJSMM301APERS.11.28.C06.1.454.light.4.raw

SEQ ID NO: 586457 - DNA, 503 bp, Homo sapiens
  misc_feature: HIJSMM301CL8D8.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccacttcggccctgggaccaaagtggatatcaacgaactgtggctgcaccatctgtctt

SEQ ID NO: 586458 - DNA, 515 bp, Homo sapiens
  misc_feature: HIJSMM301BZTMT.7.34.D01.1.454.light.4.raw
cgtgtctctacacgaccggtgctcgatttagatcgtctgtgttgggtttggggggggtctcaggaggcagtgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaacggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcgggcggagggaccaagctgaccgtcctgcgtcagcccaaggctcgccccctcggtcactt

SEQ ID NO: 586459 - DNA, 510 bp, Homo sapiens
  misc_feature: HIJSMM301BHPDL.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccgggggaccaaagtggaaatcaaacgaactgtggctgcaccatctgtcttcatcttcccgccat

SEQ ID NO: 586460 - DNA, 505 bp, Homo sapiens; identical to SEQ ID NO: 546412
  misc_feature: HIJSMM301D5A1H.22.21.B10.1.454.light.4.raw

SEQ ID NO: 586461 - DNA, 496 bp, Homo sapiens
  misc_feature: HIJSMM301C7ZL4.43.60.F05.1.454.light.4.raw
tgtgagtagtcacgaccggtgctcgatttagtacgtcatcagggaaagggcacgaccggtgctcgatttagtacgtcatcagggaaagggggagtcagacccactcaggacacagcatggacatgagggtccccgctcagctcctggggctcctgctgctctggctcccaggtgccagatggtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttggcaacttattactggtcttacaagattcttcttaccctcggacgtgtcgacggacgaccgcgt

SEQ ID NO: 586462 - DNA, 500 bp, Homo sapiens
  misc_feature: HIJSMM301ENJ4W.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggaccaagctgaccgtctgcgtcagcccaaggctgccccctcggtcactc

SEQ ID NO: 586463 - DNA, 505 bp, Homo sapiens; identical to SEQ ID NO: 558635
  misc_feature: HIJSMM301C6UY4.8.42.D09.1.454.light.4.raw

SEQ ID NO: 586464 - DNA, 488 bp, Homo sapiens
  misc_feature: HIJSMM301EXNZF.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtctaggtcagcccaaggctgccccctcggtcactctgttcccgccctcctc

SEQ ID NO: 586465 - DNA, 505 bp, Homo sapiens
  misc_feature: HIJSMM301EJ6G6.10.79.H02.1.454.light.4.raw
catagtagtgcacgaccggtgctcgatttagtgtcacacgaagggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggtccgaggggaccgaacgacgtggagatacaaaacgaaactagtggctgcaccatctgtctt

SEQ ID NO: 586466 - DNA, 506 bp, Homo sapiens; identical to SEQ ID NO: 563474
  misc_feature: HIJSMM301DL1AR.10.27.C05.1.454.light.4.raw

SEQ ID NO: 586467 - DNA, 487 bp, Homo sapiens
  misc_feature: HIJSMM301B6LWZ.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccagggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatcaaacgaactgtggctgcaccat

SEQ ID NO: 586468 - DNA, 447 bp, Homo sapiens; identical to SEQ ID NO: 535201
  misc_feature: HIJSMM301A9LXC.18.9.A09.1.454.light.4.raw

SEQ ID NO: 586469 - DNA, 506 bp, Homo sapiens
  misc_feature: HIJSMM301BUD7U.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccgggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacacaaaatacagcctctctgaccattactggtctccagcctgacgacgaggctgactactactgctcagcctgggaccaccagcctcgctgcttggcttttcggcggagggaccaagctgaccgtcctgggtcagcccaaggctgccccctcggtcta

SEQ ID NO: 586470 - DNA, 502 bp, Homo sapiens
  misc_feature: HIJSMM301EIITI.51.2.A02.1.454.light.4.raw
cgatcgtatacacgaccggtgctcgatttagactcatctacaggggctgggcctaaggaagcagcactggtggtgcctcagccatggcctggaccgttctcctcctcggcctcctctctcactgcacaggctctgtgacctcctatgtgctgagtcagccaccctcggtgtcggtggccccaggacagacggccaggattacctgtgggggaaacaacattggaagtaaaactgtgcactggtaccagcagaagccaggccaggcccctgtgctggtcgtctatgatgatgccgaccggccctcagggatccctgaacgattctctggctccagctctgagaacacggccaccctgagcatcagcagggtcgaagccggggatgaggccgactattactgtcaggtgtgggatactagtagtgatcatgtcttcggacctgggaccaaggtcaccgtcctaggtcagcccaaggccaacccactgtcactctgttcccgcct

SEQ ID NO: 586471 - DNA, 490 bp, Homo sapiens
  misc_feature: HIJSMM301BUC4S.51.62.F07.1.454.light.4.raw
cgatcgtatacacgaccggtgctcgatttagtagtcgcataaagggaaagggggagtcagtcccaaccaggacacagcatggacatgagggtccctactcagctcctggggctcctgctgctctggctctcaggtgccagatgtgacatccagatgacccagtctccgtcctccctgtctgcgtctgtaggagacagagtcaccatcacttgccaggcgagtcaggacattagcaacaatttgatctggtatcagcagaaacctggcagagcccctagtctcatgatctatgatgcatctattttggaagacggggtcccatcccggttcagtgggagtggatctgggacaaatttttctttcaccatcaccaacctgcaacctgaggattttgcaacatatttctgtcaacaatatgataatgtccccaccgtcactttcggcggaggaccaaggtggacctcaaacgaactgtggctgcaccatctgt

SEQ ID NO: 586472 - DNA, 485 bp, Homo sapiens; identical to SEQ ID NO: 536576
  misc_feature: HIJSMM301DF4B4.46.35.D02.1.454.light.4.raw

SEQ ID NO: 586473 - DNA, 475 bp, Homo sapiens; identical to SEQ ID NO: 556952
  misc_feature: HIJSMM301EDPZN.12.49.E05.1.454.light.4.raw

SEQ ID NO: 586474 - DNA, 509 bp, Homo sapiens; identical to SEQ ID NO: 539359
  misc_feature: HIJSMM301DOJ95.47.85.H08.1.454.light.4.raw

SEQ ID NO: 586475 - DNA, 506 bp, Homo sapiens
  misc_feature: HIJSMM301DWXWC.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctcgttcccaccccctcg

SEQ ID NO: 586476 - DNA, 522 bp, Homo sapiens; identical to SEQ ID NO: 543352
  misc_feature: HIJSMM301EZM75.27.23.C01.1.454.light.4.raw

SEQ ID NO: 586477 - DNA, 509 bp, Homo sapiens; identical to SEQ ID NO: 543266
  misc_feature: HIJSMM301BZR1Z.17.33.C11.1.454.light.4.raw

SEQ ID NO: 586478 - DNA, 509 bp, Homo sapiens; identical to SEQ ID NO: 539359
  misc_feature: HIJSMM301ATED9.47.85.H08.1.454.light.4.raw

SEQ ID NO: 586479 - DNA, 475 bp, Homo sapiens; identical to SEQ ID NO: 560950
  misc_feature: HIJSMM301BRKI7.5.12.B01.1.454.light.4.raw

SEQ ID NO: 586480 - DNA, 475 bp, Homo sapiens
  misc_feature: HIJSMM301EQO49.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgttccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaagtggggtcccatcaaggttcagcggcagtggatctggcacagacttcattctcaccatcagcagcctgcagcctgaagattttgcaacttattactgtctacaagatcacaattatcctgggacgttcggccaagggaccgaaggtggaaatacaaacgaaa

SEQ ID NO: 586481 - DNA, 506 bp, Homo sapiens; identical to SEQ ID NO: 534969
  misc_feature: HIJSMM301CST4Y.18.37.D04.1.454.light.4.raw

SEQ ID NO: 586482 - DNA, 489 bp, Homo sapiens
  misc_feature: HIJSMM301A5HCK.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccaatctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 586483 - DNA, 484 bp, Homo sapiens
  misc_feature: HIJSMM301D32BF.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtg

SEQ ID NO: 586484 - DNA, 494 bp, Homo sapiens
  misc_feature: HIJSMM301EE4ZG.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaaacttactaactgtcaaacagagttacagtacccccctcactttcggcggagggaccaaggcggagatcagacgaaactgtggctgcaccatctgtcttcta

SEQ ID NO: 586485 - DNA, 463 bp, Homo sapiens; identical to SEQ ID NO: 535062
  misc_feature: HIJSMM301C9NU5.11.73.G07.1.454.light.4.raw

SEQ ID NO: 586486 - DNA, 501 bp, Homo sapiens
  misc_feature: HIJSMM301CBS36.11.59.F04.1.454.light.4.raw
cgagagataccacgaccggtgctcgatttagtacacacacttagggattggggggctttgcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctccctgaacatctctgggctccaggctgaggatgaggctgattattattgctgctcatatggaagtacctactcttttctcttcggaactgggaccacggtcaccgtcctaggtcagcccaaggcccaacccactgtcactctcgttccccacctcctcgtatctctcg

SEQ ID NO: 586487 - DNA, 486 bp, Homo sapiens; identical to SEQ ID NO: 538751
  misc_feature: HIJSMM301EP96D.3.10.A10.1.454.light.4.raw

SEQ ID NO: 586488 - DNA, 497 bp, Homo sapiens
  misc_feature: HIJSMM301CTJGB.15.74.G08.1.454.light.4.raw
tctacgtagccacgaccggtgctcgatttagtagctctatcagggggcaggagtcagacccagtcaggacacagcatggacatgagggtccccgctcagctcctggggctcctgctgctctggctcccaggtgccaaatgtgacatccagatgacccagtctccttccaccctgtctgcatctgtgggagatagagtcaccatcacttgccgggccagtcagagtattagtacctggttggcctggtatcagcagaaaccagggaaagcccctaaactcctgatgtataaggcatctagcttagaaagtggggtgccatcaaggttcagcggcagtggatctgggacagaattcactctcaccatcagcaccctgcagcctaatgattttgcaacttattactgtcaacagtataatagtaattcctggacgttcggtccaagggaccaaggtggaaagtacaaacgaactagtggtctgcaccaatctgtcttcta

SEQ ID NO: 586489 - DNA, 519 bp, Homo sapiens
  misc_feature: HIJSMM301EE83F.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagccgtgtggggcaggtcagcccaaggctgccccctcggtcactctgttcccaccctcctccacg

SEQ ID NO: 586490 - DNA, 484 bp, Homo sapiens; identical to SEQ ID NO: 536162
  misc_feature: HIJSMM301A3JP3.13.59.F04.1.454.light.4.raw

SEQ ID NO: 586491 - DNA, 504 bp, Homo sapiens; identical to SEQ ID NO: 542411
  misc_feature: HIJSMM301BRXOK.9.53.E09.1.454.light.4.raw

SEQ ID NO: 586492 - DNA, 499 bp, Homo sapiens
  misc_feature: HIJSMM301BH339.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgacgggtggaaatacaaacgaactagtggctgcaccatctgtcttcatt

SEQ ID NO: 586493 - DNA, 493 bp, Homo sapiens
  misc_feature: HIJSMM301BSAAP.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatggttattgggctctattattgcatgcaagcaacacactggccgtacacttttggccaggggaccaagctggagatcaatcgaactgtgg

SEQ ID NO: 586494 - DNA, 488 bp, Homo sapiens
  misc_feature: HIJSMM301DKDGQ.41.17.B06.1.454.light.4.raw
tctatactatcacgaccggtgctcgatttagtcgatagtgaagggggaggaactgctcagttaggacccagacggaaccatggaagccccagcgcagcttctcttcctcctgctactctggctcccagatatcacaggagagatagtgatgacgcagtctccagccaccctgtctctgtctccaggggaaagagcctccctctcctgcagggccagtcagaatattcgcggccacttagcctggtatcagcagaaacctggccaggctcccaggctcctcatctatgctgcatccaccagggccactggcatcccagacaggttcagtggcagtgggtctgggacagacttcactctctccatcagcagactggagcctgaagtattttgctaatttattactgtcaccagtatggtagttcacctctaacttcggtcggagggaccgaaggtggagatacaaacgaactgtggctgcaccatctgtt

SEQ ID NO: 586495 - DNA, 496 bp, Homo sapiens
  misc_feature: HIJSMM301DPJX7.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggatttgcagtgtattactgtcagcagtatcataggtacaaacacccttcggccaagggacacgaactggagtaataaaggaactgtggctgcaccatctgtcttcatcttcccg

SEQ ID NO: 586496 - DNA, 486 bp, Homo sapiens
  misc_feature: HIJSMM301DKBCV.4.26.C04.1.454.light.4.raw
agcactgtagcacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcaactttcggcggagggaccaaggtggagatcaaacgaac

SEQ ID NO: 586497 - DNA, 484 bp, Homo sapiens
  misc_feature: HIJSMM301CRME7.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagacctttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtggaactcaaacgaactgtggctgcaccatctgtcttcatcttccgccatctgactagtctacg

SEQ ID NO: 586498 - DNA, 507 bp, Homo sapiens
  misc_feature: HIJSMM301D3SBG.13.33.C11.1.454.light.4.raw
tcacgtactacacgaccggtgctcgatttagagtgagctcgttgggtttgggggggtctcaggaggcagcgctctcggggcgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaccagtgacattggtgattataattatgtctcctggtaccaacagtgcccaggcaaagcccccaaactcataatttttactgtcagtcatcggccctcaggggtttctaatcgtttctctggctccaagtctggcaacacggcctccctgaccatctctgggctccaggctgaagacgaggctgattattactgcagctcatatacaagcggcagctctctttatctcttcggaggtggaccaaggtcaccgtcctaagtcagcccaaggccaacccatgtcact

SEQ ID NO: 586499 - DNA, 488 bp, Homo sapiens; identical to SEQ ID NO: 539612
  misc_feature: HIJSMM301BOE4S.3.55.E11.1.454.light.4.raw

SEQ ID NO: 586500 - DNA, 519 bp, Homo sapiens; identical to SEQ ID NO: 543692
  misc_feature: HIJSMM301DCJWJ.41.19.B08.1.454.light.4.raw

SEQ ID NO: 586501 - DNA, 479 bp, Homo sapiens
  misc_feature: HIJSMM301AJVLX.16.86.H09.1.454.light.4.raw
tgtactactccacgaccggtgctcgatttagtgctatagacttggggtttggggggggtcgtcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggcctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccaccctcctcgagtagtaca

SEQ ID NO: 586502 - DNA, 479 bp, Homo sapiens; identical to SEQ ID NO: 535188
  misc_feature: HIJSMM301AGJIG.10.74.G08.1.454.light.4.raw

SEQ ID NO: 586503 - DNA, 503 bp, Homo sapiens
  misc_feature: HIJSMM301BQ0D7.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttattctgtcagcagtctgaagactggccgttcactttcggcggagggaccaaggtggacctcaaacgaactgtggctgcaccatctgtcttcatcttccgcc

SEQ ID NO: 586504 - DNA, 501 bp, Homo sapiens; identical to SEQ ID NO: 536818
  misc_feature: HIJSMM301EKWLW.12.82.H05.1.454.light.4.raw

SEQ ID NO: 586505 - DNA, 509 bp, Homo sapiens
  misc_feature: HIJSMM301DOCJP.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaccacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctcgccccctcggtccactcttccg

SEQ ID NO: 586506 - DNA, 506 bp, Homo sapiens
  misc_feature: HIJSMM301AXE1Z.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcgccaagggaccgaaggtggaaatacaaacgaactagtggcgtgcaccatctgtcttctatcttccccg

SEQ ID NO: 586507 - DNA, 496 bp, Homo sapiens
  misc_feature: HIJSMM301AX6O7.16.86.H09.1.454.light.4.raw
tgtactactccacgaccggtgctcgatttagtgctatagacttgggtttgggggctggggtctcaggaggcagcgctctcaggacatctccaccatggcctgggctctgctgctcctcaccctcctcactcagggcacagggtccgtgggcccagtctgccctgactcagcctgcctccgtgtctgggtctcctggacagtcgatcatcatcttctgcactggatccagcagtgacgttggtagttataattatgtctcctggtaccaacagtacccaggcaaagccccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcgggcggtgggaccaagctgaccgtctaggtcagcccaagg

SEQ ID NO: 586508 - DNA, 473 bp, Homo sapiens
  misc_feature: HIJSMM301AXMGW.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccgagggaaacgcccctgagctcctgatctacgatgcgtccaatttggaaacagaggtcccaccgaggttcagtggaaggtggatcgtgggacagtactttactctcaccatcagcacgcctgcagcctgaagatattgcaacattattactgtacaacagtatgatcgtctcctcaatttcggccctgggaccagagtggaacatagaaacgaa

SEQ ID NO: 586509 - DNA, 496 bp, Homo sapiens; identical to SEQ ID NO: 535109
  misc_feature: HIJSMM301B2NZZ.16.78.H01.1.454.light.4.raw

SEQ ID NO: 586510 - DNA, 486 bp, Homo sapiens; identical to SEQ ID NO: 548936
  misc_feature: HIJSMM301DT27Q.5.55.E11.1.454.light.4.raw

SEQ ID NO: 586511 - DNA, 472 bp, Homo sapiens
  misc_feature: HIJSMM301CYDBN.12.49.E05.1.454.light.4.raw
  modified_base (437)..(437): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcagggtcccatctcggttcagcggcagtggatctgggacagagttcactctcaccatcagcagcctgcagcctgaagatgttgcaacttattactgtcaaaagtataacagtgcccccttnaccttcggccaagggacacgactggagattagacg

SEQ ID NO: 586512 - DNA, 502 bp, Homo sapiens
  misc_feature: HIJSMM301CKUW6.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacactttatgttcttcggaattgggacgacggtcaccgtcctaggtcagcccaaggcccaacccac

SEQ ID NO: 586513 - DNA, 505 bp, Homo sapiens
  misc_feature: HIJSMM301AXJ9F.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgatttttatatctctgtctcctggtaccaacaacacccaggcaaagccccaaactcatcatttatgatgtcactgctcggccctcaggggtttctcatcgcttttctggctccaagtctggcaccacggcctccctgaccatctcggggctccaggctgaggacgaggctgcttattactgcagctcatatacaaggagcaccactctcgtggtatttggtggagggaccaagctgaccgtcctaggtcagcccaaggctgccccctcggt

SEQ ID NO: 586514 - DNA, 481 bp, Homo sapiens
  misc_feature: HIJSMM301DL61X.48.67.G01.1.454.light.4.raw
agtatacatacacgaccggtgctcgatttagagtatacatattgggtttgggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaagctgaccgtccta

SEQ ID NO: 586515 - DNA, 486 bp, Homo sapiens; identical to SEQ ID NO: 553608
  misc_feature: HIJSMM301C47PV.11.12.B01.1.454.light.4.raw

SEQ ID NO: 586516 - DNA, 519 bp, Homo sapiens; identical to SEQ ID NO: 543692
  misc_feature: HIJSMM301A7LXG.41.19.B08.1.454.light.4.raw

SEQ ID NO: 586517 - DNA, 448 bp, Homo sapiens; identical to SEQ ID NO: 567223
  misc_feature: HIJSMM301CBE2A.18.9.A09.1.454.light.4.raw

SEQ ID NO: 586518 - DNA, 507 bp, Homo sapiens
  misc_feature: HIJSMM301DDLP1.7.1.A01.1.454.light.4.raw
cgtgtctctacacgaccggtgctcgatttagacgtctcatcaaaggaaggaaggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataagtatgtctcctggtaccaacaacacccaggcaaagcccccaaactcatgatttatgaggtcactaagcggccctcaggggtccctgatcgcttctctggctccaagtctggcaacacggcctccctgaccgtctctgggctccaggctgaagatgaggctgattattactgctgctcatatgcaggccgcaacagtgatctattcggcggagggaccaaggctgaccgtcctaggtcagcccaaggctcgccccctc

SEQ ID NO: 586519 - DNA, 490 bp, Homo sapiens
  misc_feature: HIJSMM301D0GM7.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtgagatcaaacgaa

SEQ ID NO: 586520 - DNA, 502 bp, Homo sapiens
  misc_feature: HIJSMM301BJ5EU.9.53.E09.1.454.light.4.raw
tgatacgtctcacgaccggtgctcgatttagagagagtgtgttgggtttggggctttgcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgccccctcggtcactctgttcccaccctcctcagacgtatcac

SEQ ID NO: 586521 - DNA, 488 bp, Homo sapiens
  misc_feature: HIJSMM301EMOTF.17.39.D06.1.454.light.4.raw
cgtagactagcacgaccggtgctcgatttagtgacatctcgcagttctttggggggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttggcagcaacttagcctggtatcagcagaaacctggccaggctcccaggctcctcatgtatggtgcatctaccagggccactggtgtcccagccaggttcagtggcagtgggtctgggacagagttctctctcatcatcagcagcctgcagtctgaagattttgcggtttatactgtcagcagtataatcagtggcctccgtggacgttcggccaagggaccaaggtggaaatcaaacgaactgtggctgca

SEQ ID NO: 586522 - DNA, 486 bp, Homo sapiens; identical to SEQ ID NO: 535290
  misc_feature: HIJSMM301DXOG6.3.12.B01.1.454.light.4.raw

SEQ ID NO: 586523 - DNA, 487 bp, Homo sapiens
  misc_feature: HIJSMM301CDOAC.49.64.F09.1.454.light.4.raw
agtcgagagacacgaccggtgctcgatttagcgcgtatacaagggggagtcagtctcagtcaggacacagcatggacatgagggtccccgctcagctcctggggctcctgctactctggctccgaggtgccagatgtgacatccagatgacccagtctccatccgccctgtctgcatctgtaggagacagagtcaccatcatttgccgggcaagtcagagtattagcaactatttaaattggtatcagcataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 586524 - DNA, 474 bp, Homo sapiens
  misc_feature: HIJSMM301A1TQQ.15.81.H04.1.454.light.4.raw
  modified_base (392)..(392): a, c, t, g, unknown or other
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggnggacgggacaagctgaccgtcctaggtcagcccaaggctcgccccctcggtcactctgttcccgccctcctcgctacgtaga

SEQ ID NO: 586525 - DNA, 501 bp, Homo sapiens
  misc_feature: HIJSMM301EGOJR.9.12.B01.1.454.light.4.raw
  modified_base (423)..(423): a, c, t, g, unknown or other
  modified_base (430)..(430): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacngttttcncgggcttcggccaagggaccaaggtggaatacaacgaactgtggctgcaccatctgtcttcatcttccccg

SEQ ID NO: 586526 - DNA, 518 bp, Homo sapiens
  misc_feature: HIJSMM301C6GPS.8.23.C01.1.454.light.4.raw
ctcgcgtgtccacgaccggtgctcgatttagtacacgtgattagggattggggctgggcctcaggaagcagcatcgggggtgccgcagccatggcctggaccgctctccttctgagcctccttgctcactttacaggttctgtggcctcctatgagctgactcagccactctcagtgtcagtggccccgggacagacggccaggattacctgtggggggttcaatattggaggtaacaatgtgcactggtaccagcagaaggcagggcaggcccctgtactggtcatctatgggggatccatccggccaggtgggacccctgcgcgattctctgcctccatctcggggaacgcggccaccctgaccatcagcaaagcccaagccggtgatgaggctgactatttttgtcaggtgtgggacagcagcatttatgtcttcggacctgggaccaaggtcaccgtcctaggtcagcccaaggcccaaccccactcgtcactctgttcccaccctcctcgacc

SEQ ID NO: 586527 - DNA, 483 bp, Homo sapiens; identical to SEQ ID NO: 571295
  misc_feature: HIJSMM301CK1M6.46.35.D02.1.454.light.4.raw

SEQ ID NO: 586528 - DNA, 504 bp, Homo sapiens
  misc_feature: HIJSMM301DTZ9L.47.55.E11.1.454.light.4.raw
agctcacgtacacgaccggtgctcgatttagcactcgcacgttgggtcttgggcccagtctgtgctgactcagccaccctcagcgtctgggacccccgggcagacggtcaccatctcttgttctggaagcagctccaatatcggaaatgataatgtatactggtaccagcaagtcccacgaacggcccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggaccaaggtcaccgtcctagggcacgtgagactcaggaaatgaccagaggggagtgaatgaggggtgcagagaactccatggctaccaggtcagcccaaggcccaaccccactgtcactctgttcccgccctcctcta

SEQ ID NO: 586529 - DNA, 499 bp, Homo sapiens; identical to SEQ ID NO: 583423
  misc_feature: HIJSMM301DNZC5.41.35.D02.1.454.light.4.raw

SEQ ID NO: 586530 - DNA, 503 bp, Homo sapiens; identical to SEQ ID NO: 540665
  misc_feature: HIJSMM301DQDEF.4.57.F02.1.454.light.4.raw

SEQ ID NO: 586531 - DNA, 520 bp, Homo sapiens
  misc_feature: HIJSMM301C4G46.27.23.C01.1.454.light.4.raw
  modified_base (499)..(499): a, c, t, g, unknown or other
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgcccccncggtcactctgttcccgccct

SEQ ID NO: 586532 - DNA, 498 bp, Homo sapiens; identical to SEQ ID NO: 542739
  misc_feature: HIJSMM301AO7OD.10.77.G11.1.454.light.4.raw

SEQ ID NO: 586533 - DNA, 474 bp, Homo sapiens
  misc_feature: HIJSMM301ETRGR.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcgccctggactgaagtgcatatgaagagaactgtggctgca

SEQ ID NO: 586534 - DNA, 509 bp, Homo sapiens
  misc_feature: HIJSMM301B7FFX.47.85.H08.1.454.light.4.raw
agctcacgtacacgaccggtgctcgatttagtatcactcagtcgcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctcgcccctcggtcactctgtt

SEQ ID NO: 586535 - DNA, 494 bp, Homo sapiens; identical to SEQ ID NO: 534992
  misc_feature: HIJSMM301BNNS3.9.1.A01.1.454.light.4.raw

SEQ ID NO: 586536 - DNA, 487 bp, Homo sapiens
  misc_feature: HIJSMM301AU9JM.12.1.A01.1.454.light.4.raw
atacgacgtacacgaccggtgctcgatttagacgtctcatcagggcacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtggggtcccatcaaggttcagtggcagtgggtctgggacagatttcactctcaccatcagcagtctgcaacctgaagattctgcaacttattactgtcaacagagtaacagttaccctcccactttcggtcggagggaccgaacggtaggaggatcaaacgaactagtggcgtgcaccatctgtcttctatcttcccgtccca

SEQ ID NO: 586537 - DNA, 485 bp, Homo sapiens
  misc_feature: HIJSMM301CK5ZB.10.77.G11.1.454.light.4.raw
  modified_base (468)..(468): a, c, t, g, unknown or other
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtgtccacggacgaacgtaggacgagtacaanacgaacagtaggcgtgg

SEQ ID NO: 586538 - DNA, 471 bp, Homo sapiens
  misc_feature: HIJSMM301E13MI.11.76.G10.1.454.light.4.raw
cgagagataccacgaccggtgctcgatttagtcactcatacagggagctacaacaggcaggcaggggcagcaagatggtgttgcagacccaggtcttcatttctctgttgctctggatctctggtgcctgcggagacatcgtgatgacccagtctccagattccctggctgtgtctctgggcgagacggccaccatcaactgcaagtccagtcagaatcttttagactattccactaagagagatttgttagtttggtaccaacagaagccaggccagcctccaaagcagctcatttattgggcatctactcgggattccggggtccctgaccgattccgtggcagtggatctgggacaaatttcactctcaccatcaatagcctgcaggctgaagatgtggcagcttattattgtcagcaatattatacttctcttccgatcacttttggccagggaccaggctggagat

SEQ ID NO: 586539 - DNA, 352 bp, Homo sapiens
  misc_feature: HIJSMM301EF65L.3.11.A11.1.454.light.4.raw
agacgcactccacgaccggtgctcgatttagctacgactgcagggccagtgagactgttagcagcagctacttagcctggtaccagcacaaacctggccaggctcccagtctcctcatctttggtgcatccagcagggcccctggcatcccagacaggttcagtggcagtgggtctgggacagacttcactctcaccatcagcagactggagcctgaagattttgcagtgtattactgtcaggtctatggttactcacctcggttcagctttggccaggggaccaaggtggagatcaaacgaactgtggctgcaccatctgtcttcatcttcccgccatctgagagtgcgtc

SEQ ID NO: 586540 - DNA, 485 bp, Homo sapiens; identical to SEQ ID NO: 535501
  misc_feature: HIJSMM301CHINC.3.10.A10.1.454.light.4.raw

SEQ ID NO: 586541 - DNA, 482 bp, Homo sapiens
  misc_feature: HIJSMM301BFR9P.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggtcggagggaccgaagctgaccgtcctaagtcagaccccg

SEQ ID NO: 586542 - DNA, 489 bp, Homo sapiens
  misc_feature: HIJSMM301CZZI8.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctctttactggacttcgatccgcgcatctggggtccctgaccgattcatgggcagcggctctgggacagacttcgctctcaccatcaacagcctccaggctgaggatggcggcggttttattattgtcaacaatattttagtgctccgtacacttttggccaggggaccaagttggagatcaaacgaa

SEQ ID NO: 586543 - DNA, 518 bp, Homo sapiens
  misc_feature: HIJSMM301DM6XT.48.41.D08.1.454.light.4.raw
agtatacatacacgaccggtgctcgatttagtcacgcgagaaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctggtcactctgttcccacct

SEQ ID NO: 586544 - DNA, 513 bp, Homo sapiens; identical to SEQ ID NO: 547639
  misc_feature: HIJSMM301DLTKQ.43.59.F04.1.454.light.4.raw

SEQ ID NO: 586545 - DNA, 487 bp, Homo sapiens; identical to SEQ ID NO: 558255
  misc_feature: HIJSMM301A624J.12.33.C11.1.454.light.4.raw

SEQ ID NO: 586546 - DNA, 485 bp, Homo sapiens; identical to SEQ ID NO: 539299
  misc_feature: HIJSMM301ERHN6.3.10.A10.1.454.light.4.raw

SEQ ID NO: 586547 - DNA, 501 bp, Homo sapiens
  misc_feature: HIJSMM301DXBD1.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctgggtgcttatctcttcggacctgggaccaaggtcaccgtctggt

SEQ ID NO: 586548 - DNA, 509 bp, Homo sapiens; identical to SEQ ID NO: 535670
  misc_feature: HIJSMM301AZAW2.47.23.C01.1.454.light.4.raw

SEQ ID NO: 586549 - DNA, 494 bp, Homo sapiens
  misc_feature: HIJSMM301CWM1X.10.63.F08.1.454.light.4.raw
catagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaacagcctagaacctgaagattttgcactttatttctgtcaccagagtcgcaactggcctccgacgttcggccagggaccaaggtggagatcagacgaactgtggctgcacatctgtcttcatcttcccg

SEQ ID NO: 586550 - DNA, 496 bp, Homo sapiens; identical to SEQ ID NO: 564809
  misc_feature: HIJSMM301AMCMT.22.20.B09.1.454.light.4.raw

SEQ ID NO: 586551 - DNA, 444 bp, Homo sapiens; identical to SEQ ID NO: 540477
  misc_feature: HIJSMM301DOAPU.17.21.B10.1.454.light.4.raw

SEQ ID NO: 586552 - DNA, 502 bp, Homo sapiens
  misc_feature: HIJSMM301D2PZN.3.53.E09.1.454.light.4.raw
  modified_base (481)..(481): a, c, t, g, unknown or other
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaaacctgcaggctgaagatgtggcctttattactgtcagcaaatattaatggtactcctccgtgacgttcgcacggaccgaagtaggaagnaaacgaacaatgcgtgcacca

SEQ ID NO: 586553 - DNA, 502 bp, Homo sapiens; identical to SEQ ID NO: 543132
  misc_feature: HIJSMM301CSOWX.17.28.C06.1.454.light.4.raw

SEQ ID NO: 586554 - DNA, 489 bp, Homo sapiens; identical to SEQ ID NO: 535139
  misc_feature: HIJSMM301DH0YG.14.55.E11.1.454.light.4.raw

SEQ ID NO: 586555 - DNA, 507 bp, Homo sapiens; identical to SEQ ID NO: 547790
  misc_feature: HIJSMM301CW4CX.21.87.H10.1.454.light.4.raw

SEQ ID NO: 586556 - DNA, 469 bp, Homo sapiens
  misc_feature: HIJSMM301AIDCY.52.59.F04.1.454.light.4.raw
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaacgaa

SEQ ID NO: 586557 - DNA, 519 bp, Homo sapiens
  misc_feature: HIJSMM301EDURW.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaacgggaccaaggtggcaatcaaccgaactgtggctgcaccatctgtcttcatcttccccg

SEQ ID NO: 586558 - DNA, 477 bp, Homo sapiens
  misc_feature: HIJSMM301EHFVB.43.63.F08.1.454.light.4.raw
tgtgagtagtcacgaccggtgctcgatttagcgatcgtataagggggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccttcgcttgccgggcaagtcaggacattaaaagtgatttaggctggtatcagcagaaaccagggaaagcccctaagctcctgatctatgctgcatccactttacaaagtggagtcccatcaaggttcagcggcagtggatctggcacagatttcactctcaccatcagcagcctgcagcctgaagattctgcaacttattactgtctacacgattacaattaccctcgacgttcggccaagggaccaaaggtggaaatcaaacgaactgtggctgcaccat

SEQ ID NO: 586559 - DNA, 511 bp, Homo sapiens
  misc_feature: HIJSMM301C468N.9.12.B01.1.454.light.4.raw
  modified_base (423)..(423): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaaacngttttctcgggcgttcggtccgaacggacgaacggtggaaagtacaaacgaactagtgcgtcgcaccactctgtcttcatcttccccg

SEQ ID NO: 586560 - DNA, 505 bp, Homo sapiens
  misc_feature: HIJSMM301C89FA.27.78.H01.1.454.light.4.raw
  modified_base (460)..(460): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagtactactttaccncaagtgatcaccttcggccaagggacacgactggagattaaaacg

SEQ ID NO: 586561 - DNA, 485 bp, Homo sapiens; identical to SEQ ID NO: 575464
  misc_feature: HIJSMM301AUEKF.26.60.F05.1.454.light.4.raw

SEQ ID NO: 586562 - DNA, 522 bp, Homo sapiens
  misc_feature: HIJSMM301AONZV.19.72.G06.1.454.light.4.raw
tactctcgtgcacgaccggtgctcgatttagctacgactgcaagggaaaggggggggtcgcaagaggcagcgctctcgggacgtctccaccatggcctgggctctgctgctcctcactctcctcactcaggacacagggtcctgggcccagtctgccctgactcagcctgcctccgtgtctgagtctcttggacagtcgatcaccatctcctccactgggaccggtcgtgatgttgggacttatacccttgtctcctggtaccaacaataccccggcaaagcccccaaactcctgatttatgaggctcataagcggccctcaggggtttctgagcgcttctctggctccagggctgacaacacggcctacctgacgatctctgggctccaggctgaggacgaggctgactattattgctgcgcatacgcaggaagtagcacattgggtggtgcgggcgggagggaccgaagggtgaccgtccgtgggtcacgcccgaaggcgtcgcccccgtcggtcactcg

SEQ ID NO: 586563 - DNA, 493 bp, Homo sapiens; identical to SEQ ID NO: 535745
  misc_feature: HIJSMM301A5HVD.47.78.H01.1.454.light.4.raw

SEQ ID NO: 586564 - DNA, 354 bp, Homo sapiens; identical to SEQ ID NO: 540485
  misc_feature: HIJSMM301C6BXB.40.9.A09.1.454.light.4.raw

SEQ ID NO: 586565 - DNA, 476 bp, Homo sapiens
  misc_feature: HIJSMM301A79HT.51.72.G06.1.454.light.4.raw
cgatcgtatacacgaccggtgctcgatttagctacgactgcaagggaaagggggcaggagtcagtcccaaccaggacacagcatggacatgagggtccctgctcagctcctggggctcctgctgctctggctctcaggtggcagatgtatcatccagatgacccagtctccatcctccctgtctgcatatataggagacagaatcaccatcacttgccgggcgagtcaggacattagcgtatatttgaattggtatcagcaaaaaccagggaaagcccctgagctcctgatcctcgatgcatccactttggaaacagggtcccatcaaggttcagtggaagtggctctgggacacattttactttcaccatcagcagactgcagcctgaagatgttgcaacatattactgtcaacagtatcataatctcccgctcactttcggcggagggaccaaggtggagatcaaacgaactgt

SEQ ID NO: 586566 - DNA, 494 bp, Homo sapiens; identical to SEQ ID NO: 557282
  misc_feature: HIJSMM301C3DDX.51.29.C07.1.454.light.4.raw

SEQ ID NO: 586567 - DNA, 499 bp, Homo sapiens
  misc_feature: HIJSMM301CA3MN.41.3.A03.1.454.light.4.raw
tctatactatcacgaccggtgctcgatttagagagcgtcacaggggagagctgctcagttaggacccagagggaaccatggaaaccccagcgcagcttctcttcctcctgctactctggctcccaggtgccaccggagaaattgtgttgacgcagtctccaggcaccctgtctttctctccaggggaaagagccaccctctcctgcagggccagtcagagtgttgacaaccagtacttcgcctggtaccagcagaaacctggccaggctcccaggctcctcatggatggtgcatccagcagggccactggcatcccagacaggttcggtggcagtgggtctgggacagacttcactctcaccatcagcagcctggagcctgaagattttgtagtgtattactgtcagcagtatcttacaacgaccggggagttttggccgaggggaccaagctggagatcaaacgaactgtggctgcaccatctgtcttcatcttcccg

SEQ ID NO: 586568 - DNA, 499 bp, Homo sapiens
  misc_feature: HIJSMM301D0AEX.16.38.D05.1.454.light.4.raw
tgtactactccacgaccggtgctcgatttagtatctgatagttgggtttgggggaggaactgctcagttaggacccagacggaaccatggaagccccagcgcagcttctcttcctcctgctactctggctcccagacacgactggagaagtagtgatgacgcagtctccagccaccctgtctgtgtctccaggggaaagcgccaccctctcctgcagggccagtcagagtgttgccaccaatttagcctggtaccagcaaaaacctggccaggctcccaggctcctcatctatggtgcatctaccagggccactgatgtcccaggccggttcagtggcagtgggtttgggacagacttcactctcaccatcagcaccctgcagtctgaggattttgcaatttattattgtcagcagtataattactggcctccgtacacttttggccaggggaccaagctggagatcaacgaactgtggctgcaccatctgtcttcatt

SEQ ID NO: 586569 - DNA, 454 bp, Homo sapiens
  misc_feature: HIJSMM301D9T0B.19.86.H09.1.454.light.4.raw
  modified_base (429)..(429): a, c, t, g, unknown or other
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactcngttcccaccctcctccacgagagta

SEQ ID NO: 586570 - DNA, 453 bp, Homo sapiens
  misc_feature: HIJSMM301CV3P9.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctggtcactctgttcccaccctcctccacgagagta

SEQ ID NO: 586571 - DNA, 521 bp, Homo sapiens; identical to SEQ ID NO: 539470
  misc_feature: HIJSMM301AWWXL.27.23.C01.1.454.light.4.raw

SEQ ID NO: 586572 - DNA, 479 bp, Homo sapiens
  misc_feature: HIJSMM301CLNYA.16.4.A04.1.454.light.4.raw
tgtactactccacgaccggtgctcgatttagagtagtgatcagggggagtcagactcagtcaggacacagcatggacatgagggtccccgctcagctcctggggctcctgctgctctggctcccaggtgccaaatgtgacatccagatgacccagtctccttccaccctgtctgcatctgtaggagacagagtcaccatcgcttgccgggccactcagagtgttagcaggtggttggcctggtatcagcagaaaccagggaaggcccctgaactcctgatctatgatgccagcagtttgaaaagtggggtcccatcaagattcagcggcagtggatctgggacagagttcactctcaccatcagcagcctgcagcctgatgattttgcaacctattattgccaacagtataatagttatccgtggacgttcggtccaagggaccaagggtggacgatcaaacgaactgtggctgcacca

SEQ ID NO: 586573 - DNA, 505 bp, Homo sapiens; identical to SEQ ID NO: 582898
  misc_feature: HIJSMM301A0P5S.13.25.C03.1.454.light.4.raw

SEQ ID NO: 586574 - DNA, 479 bp, Homo sapiens; identical to SEQ ID NO: 535118
  misc_feature: HIJSMM301DE1RO.13.59.F04.1.454.light.4.raw

SEQ ID NO: 586575 - DNA, 506 bp, Homo sapiens
  misc_feature: HIJSMM301EWO6O.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaacgcccccaaactcatcatttatgaggtcactaagcggccctcaggggtttctattcgcttctctggctccaagtctgacaacacggcctcctgacaatctctgggctccaggctgaggacgaggctgattattactgctgctcatatgcagatggtgacactcccgtggtattcggcggagggaccaaggtgaccgtcctaggtcagccccaaggctcgccccccg

SEQ ID NO: 586576 - DNA, 521 bp, Homo sapiens; identical to SEQ ID NO: 539470
  misc_feature: HIJSMM301AU1UD.27.23.C01.1.454.light.4.raw

SEQ ID NO: 586577 - DNA, 482 bp, Homo sapiens
  misc_feature: HIJSMM301EW6P7.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtcgccttgcaatcgggggtcccatctcggttcagtggcggtggatctaggacagaattcactctcaccatcaccaacctgcaccctgaagatgttggaagttattactgtcagacctatagtggtggcccgctcattttcggcgagggaccaaggtgcagatcaaacgaactgtggctgca

SEQ ID NO: 586578 - DNA, 504 bp, Homo sapiens; identical to SEQ ID NO: 539032
  misc_feature: HIJSMM301AKC4C.19.67.G01.1.454.light.4.raw

SEQ ID NO: 586579 - DNA, 487 bp, Homo sapiens
  misc_feature: HIJSMM301BKBEO.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagatttgcaacttactactgtcaacagagttacggtaccccgtacaccttttggccagggaccaaactggacatcaaacgaactgtggctgcaccatctgtt

SEQ ID NO: 586580 - DNA, 485 bp, Homo sapiens
  misc_feature: HIJSMM301EFTSC.47.38.D05.1.454.light.4.raw
agctcacgtacacgaccggtgctcgatttagtatctgatagttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggtctgatcgggcctccggggtccctgacaggttcagtggcagtggatcaggcacagattttacgctgaaaatcagtagggtggaggctgaggatgttggggtttattactgcatgcaagttctacaaacttcctacacttttggccaggggaccaagctggagatcaacgaa

SEQ ID NO: 586581 - DNA, 494 bp, Homo sapiens
  misc_feature: HIJSMM301ANODF.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaatgatcaccttcggccaagggacacgactgagattaaacgaactagtggctgcaccactctgtctt

SEQ ID NO: 586582 - DNA, 494 bp, Homo sapiens
  misc_feature: HIJSMM301EN5JZ.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggccccaagctcctcatctatagaaattatgaacggtcctcaggggtccctgaccgattctctggctccaagtctggcacctcagcctccctggccatcagtgggctccggtccgaggatgaggctgattattactgtgttggatgggacagcagcctgagtgcttatgtcttcggaactggaccacggtcaccgtct

SEQ ID NO: 586583 - DNA, 496 bp, Homo sapiens
  misc_feature: HIJSMM301AEDN1.43.25.C03.1.454.light.4.raw
tgtgagtagtcacgaccggtgctcgatttagtagtgtagatttgggtttgggggatcaggactcctcagttcaccttctcacaatgaggctccctgctcagctcctggggctgctaatgctctgggtcccaggatccagtggggatgttgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccgctcacttcggtcggagggaccaaggtggaggatacaaacgaactgtggctgca

SEQ ID NO: 586584 - DNA, 490 bp, Homo sapiens
  misc_feature: HIJSMM301C1DKY.52.28.C06.1.454.light.4.raw
cgcagtacgacacgaccggtgctcgatttagagctcacgtattgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacggtatccctgatcgcttctcaggctccggctctgggactgagcgctacctcaccatctccagccctcagtctgaggacgagggtgactattactgtcagacgtgggacactggcagttttgggtgttcgggcggagggaccaaggttgaccgtcctaggtcaggcccaaggctcc

SEQ ID NO: 586585 - DNA, 505 bp, Homo sapiens; identical to SEQ ID NO: 535987
  misc_feature: HIJSMM301ADXSV.18.37.D04.1.454.light.4.raw

SEQ ID NO: 586586 - DNA, 470 bp, Homo sapiens; identical to SEQ ID NO: 536130
  misc_feature: HIJSMM301C4741.7.81.H04.1.454.light.4.raw

SEQ ID NO: 586587 - DNA, 485 bp, Homo sapiens; identical to SEQ ID NO: 536040
  misc_feature: HIJSMM301CQ5VT.15.1.A01.1.454.light.4.raw

SEQ ID NO: 586588 - DNA, 488 bp, Homo sapiens; identical to SEQ ID NO: 541987
  misc_feature: HIJSMM301BN7E7.8.12.B01.1.454.light.4.raw

SEQ ID NO: 586589 - DNA, 509 bp, Homo sapiens
  misc_feature: HIJSMM301AFMWK.18.11.A11.1.454.light.4.raw
  modified_base (493)..(493): a, c, t, g, unknown or other
tacgagtatgcacgaccggtgctcgatttagctacgactgcagggggagctacaacaggcaggcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttacttgggcatctacccgggagtccggggtcccgtgaccgattcagaggcagcgggtcgtgggacagatttcactctcaccatcaccaacctgcaggctgaagatgtggcagtttattactgtcagcaatactatagtcctccctctcacgtcggcggagggaccaacggtggagatacaaaccgaaactgtggntcgcaccatctgtctt

SEQ ID NO: 586590 - DNA, 502 bp, Homo sapiens; identical to SEQ ID NO: 544444
  misc_feature: HIJSMM301CEZCD.5.24.C02.1.454.light.4.raw

SEQ ID NO: 586591 - DNA, 489 bp, Homo sapiens
  misc_feature: HIJSMM301BBDPE.3.55.E11.1.454.light.4.raw
agacgcactccacgaccggtgctcgatttagcactcgcacgttgggtttgggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagtattttgctaatttattactgtcagcagtataataactggtggacgttcggccaagggaccaaggtagaaatcaaacgaactgtggctgcaccatctgt

SEQ ID NO: 586592 - DNA, 507 bp, Homo sapiens; identical to SEQ ID NO: 557429
  misc_feature: HIJSMM301DT2EO.15.59.F04.1.454.light.4.raw

SEQ ID NO: 586593 - DNA, 490 bp, Homo sapiens; identical to SEQ ID NO: 535526
  misc_feature: HIJSMM301B3HEV.26.78.H01.1.454.light.4.raw

SEQ ID NO: 586594 - DNA, 519 bp, Homo sapiens
  misc_feature: HIJSMM301EFGBN.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggaccccagaccctggagcctcagttggaagcagccgatccagcctgcggagcctgtggggcaggtcagcccaaggccaacccactgtcactcttcg

SEQ ID NO: 586595 - DNA, 504 bp, Homo sapiens
  misc_feature: HIJSMM301DXTU9.40.25.C03.1.454.light.4.raw
tctagcgactcacgaccggtgctcgatttagtagtgtagatttgggtttggggggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctcacgttcggcggagggaccaaggtggacatcaaacgaactgtggctgcaccatctgtcttcatcttcccgcat

SEQ ID NO: 586596 - DNA, 513 bp, Homo sapiens
  misc_feature: HIJSMM301BFZAT.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgtcccgccctcct

SEQ ID NO: 586597 - DNA, 499 bp, Homo sapiens
  misc_feature: HIJSMM301B8BA7.52.29.C07.1.454.light.4.raw
cgcagtacgacacgaccggtgctcgatttagagtgctacgaagggaaagggggtgggtccaggaggcagaactctgggtgtctcaccattgcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccagcagaagccaggccaggcccctgtgttgttgatatataaagacactgagaggccttcagggatccctgagcgcttctctggctccacctcagggacaatggtcacattgaccatcagtggagtccaggcagaagacgaggctgactatttctgtcaatcttcagacatcagtggtacttatgtcttcggaactgggaccaaggtcaccgtcctaggtcagcccaaggccaaccccactgtcactctcg

SEQ ID NO: 586598 - DNA, 444 bp, Homo sapiens
  misc_feature: HIJSMM301CPIIB.47.85.H08.1.454.light.4.raw
agctcacgtacacgaccggtgctcgatttagtatcactcagtcgcggggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgttcccgccctcctctacgtgagct

SEQ ID NO: 586599 - DNA, 495 bp, Homo sapiens; identical to SEQ ID NO: 535821
  misc_feature: HIJSMM301A0X9H.3.31.C09.1.454.light.4.raw

SEQ ID NO: 586600 - DNA, 521 bp, Homo sapiens; identical to SEQ ID NO: 538715
  misc_feature: HIJSMM301B7IYQ.27.23.C01.1.454.light.4.raw

SEQ ID NO: 586601 - DNA, 498 bp, Homo sapiens
  misc_feature: HIJSMM301EP0BQ.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagaccaaccccactcgt

SEQ ID NO: 586602 - DNA, 504 bp, Homo sapiens; identical to SEQ ID NO: 538423
  misc_feature: HIJSMM301EPXKX.48.67.G01.1.454.light.4.raw

SEQ ID NO: 586603 - DNA, 441 bp, Homo sapiens; identical to SEQ ID NO: 550529
  misc_feature: HIJSMM301BM2E3.41.9.A09.1.454.light.4.raw

SEQ ID NO: 586604 - DNA, 505 bp, Homo sapiens
  misc_feature: HIJSMM301AOWBX.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggcccaggcagatgatgagtgtgattattactgtgtgctctatatggcagtggcgtttgggtgttcggcggagggaccaagctgaccgttcg

SEQ ID NO: 586605 - DNA, 484 bp, Homo sapiens; identical to SEQ ID NO: 535400
  misc_feature: HIJSMM301CH8I0.46.26.C04.1.454.light.4.raw

SEQ ID NO: 586606 - DNA, 484 bp, Homo sapiens; identical to SEQ ID NO: 535400
  misc_feature: HIJSMM301BDVFU.46.26.C04.1.454.light.4.raw

SEQ ID NO: 586607 - DNA, 506 bp, Homo sapiens; identical to SEQ ID NO: 534969
  misc_feature: HIJSMM301ATV8E.18.37.D04.1.454.light.4.raw

SEQ ID NO: 586608 - DNA, 513 bp, Homo sapiens
  misc_feature: HIJSMM301ERFFM.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtgtaca

SEQ ID NO: 586609 - DNA, 524 bp, Homo sapiens
  misc_feature: HIJSMM301ER414.27.23.C01.1.454.light.4.raw
agcgtcgtctcacgaccggtgctcgatttagtacacgtgattagggattggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggtcggagggaccaggctgaccgtcctaggtcagcccaaggctgccccctcggtcactctcgttcccaccct

SEQ ID NO: 586610 - DNA, 547 bp, Homo sapiens
  misc_feature: HIJSMM301CUTRZ.5.28.C06.1.454.light.4.raw
  modified_base (517)..(517): a, c, t, g, unknown or other
atcagacacgcacgaccggtgctcgatttagagctcacgtattgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacccgcttaaaccgggacaaccgtcgcccggccaacatagccttctccgtcccccttcgcagtaacaccaagtacaggaatattaacctgtttcccatcgactacgcctttcggcctcgccttaggggtcgactcaccctgccccgattaacgttggacaggaacccttggtcttccggcgagcgggcttttcgacccgcgtttatcgttacttatgtcagcattcgcacttctgatacctccagcatgcctcacagcacaccttcacaggcttacagaacgctccccacccaacaacgcataagcgtcgctgccgcagcttcggtgcatggtttanccccgtttcatcttcccgccatcctgacgt

SEQ ID NO: 586611 - DNA, 486 bp, Homo sapiens; identical to SEQ ID NO: 535043
  misc_feature: HIJSMM301B9KDW.46.35.D02.1.454.light.4.raw

SEQ ID NO: 586612 - DNA, 515 bp, Homo sapiens
  misc_feature: HIJSMM301ADMPE.49.11.A11.1.454.light.4.raw
agtcgagagacacgaccggtgctcgatttagctacgactgcaggggtgggcctaaggaagcagcactggtggtgcctcagccatggcctggaccgttctcctcctcggcctcctctctcactgcacagactctgtgacctcctatgtgctgactcagccaccctcggtgtcagtggcccctggacagacggccaggattacctgtgggggaaacgacattggaagtaagactgtgcactggtaccagcagaagccaggccaggcccctgtgctggtcgtctatggtgatggcgaccggccctcagggatccctgagcgattctctggctccaactctgggaacccggccaccctgaccatcagccgggtcgaagacggggatgaggccgactattactgtcaggtgtgggatagtggtagtggtgtcgtcttcggagctgggaccagggtcaccgtcctaggtcagcccaaggccaaccccactgtcactctgttcccgccctcctctctctcga

SEQ ID NO: 586613 - DNA, 508 bp, Homo sapiens
  misc_feature: HIJSMM301EZJ4X.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgactgtggctgcaccatctgtcttcatcttcccg

SEQ ID NO: 586614 - DNA, 484 bp, Homo sapiens; identical to SEQ ID NO: 539003
  misc_feature: HIJSMM301EVQV8.10.1.A01.1.454.light.4.raw

SEQ ID NO: 586615 - DNA, 441 bp, Homo sapiens; identical to SEQ ID NO: 550529
  misc_feature: HIJSMM301AO27G.41.9.A09.1.454.light.4.raw

SEQ ID NO: 586616 - DNA, 492 bp, Homo sapiens
  misc_feature: HIJSMM301BQV0O.40.40.D07.1.454.light.4.raw
tctagcgactcacgaccggtgctcgatttagtgatagagcgtaacaacagagggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcaggaggaccaagctgaccgtcctaggtcagcccaagg

SEQ ID NO: 586617 - DNA, 499 bp, Homo sapiens
  misc_feature: HIJSMM301CATQ8.4.22.B11.1.454.light.4.raw
agcactgtagcacgaccggtgctcgatttagacgacagctcaggggaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtgtacagtgatggaaacacctacttgaattggtttcagcagaggccaggccaatctccaaggcgcctaatttatgaggtttctaaccgggactctggggtcccagacagattcagcggcagtgggtcaggcactgatttcacactgaaaatcagcacggtggaggctgaggatgttggggtttatttctgtcatgcaagggtacacactggccgtacacttttggccaggggaccaagctggagatcaaacgaactgtggctggcaccatcctgtcttt

SEQ ID NO: 586618 - DNA, 506 bp, Homo sapiens
  misc_feature: HIJSMM301D24VK.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattggcggagggaccaaactgaccgtcctaggtcagccccaaaggcgtcgccccctcc

SEQ ID NO: 586619 - DNA, 354 bp, Homo sapiens; identical to SEQ ID NO: 535026
  misc_feature: HIJSMM301C28XD.19.22.B11.1.454.light.4.raw

SEQ ID NO: 586620 - DNA, 493 bp, Homo sapiens; identical to SEQ ID NO: 536296
  misc_feature: HIJSMM301A1AF7.5.48.E04.1.454.light.4.raw

SEQ ID NO: 586621 - DNA, 464 bp, Homo sapiens
  misc_feature: HIJSMM301EWA28.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccaggggaaagagccaccctctcctgcagggccagtcagagtattaacagcgacttagcctggtaccagcagaaacctggccaggctcccaggctcctcatctatggtgcatccaccagggccactggcatcccagccaggttcagtggcagtgggtctgggacagacttcgctctcaccatcagcagcctagagcctgaagattttgcagtttattattgtcagcagcgaaacaactggcctccttggacgttcggccaagggaccaaggtggaaatcaaacgaactagtggctgcaccatctgtcttcatcttcccgccatctgatcgtagcact

SEQ ID NO: 586622 - DNA, 501 bp, Homo sapiens; identical to SEQ ID NO: 536142
  misc_feature: HIJSMM301BMVNI.15.1.A01.1.454.light.4.raw

SEQ ID NO: 586623 - DNA, 498 bp, Homo sapiens
  misc_feature: HIJSMM301CRH6L.40.42.D09.1.454.light.4.raw
  modified_base (411)..(411): a, c, t, g, unknown or other
tctagcgactcacgaccggtgctcgatttagacacatacgcagggaaagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgccaaaaaaatatgcttattggtaccaacagaagtcaggccaggcccctgtgctggtcatctatgaggacaacaaacgaccctccgagatccctgagagattctctggctccagctcagggacaatggccaccttggctctcagtgggcccaggtggaggatgaagctgactactactgttacncagtggacagcagtggaaatcatggggtattcggcggagggccaagctgaccgtcctaggtcagcccaaggctgccccctcggtcta

SEQ ID NO: 586624 - DNA, 492 bp, Homo sapiens
  misc_feature: HIJSMM301EP5Q8.26.78.H01.1.454.light.4.raw
  modified_base (344)..(344): a, c, t, g, unknown or other
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacgcagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagggtnagtctgggacagacttcactctcaccatcagcagcctagagcctgaagattttgcactttattactgtcagcagcgtagcaactggcctctcactttcggcggagggaccagggtggagatcagacgaactgtggctgcaccatctgt

SEQ ID NO: 586625 - DNA, 488 bp, Homo sapiens; identical to SEQ ID NO: 537673
  misc_feature: HIJSMM301DL3T4.12.31.C09.1.454.light.4.raw

SEQ ID NO: 586626 - DNA, 482 bp, Homo sapiens; identical to SEQ ID NO: 549843
  misc_feature: HIJSMM301ECZ3A.3.38.D05.1.454.light.4.raw

SEQ ID NO: 586627 - DNA, 499 bp, Homo sapiens
  misc_feature: HIJSMM301CYFU6.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcggcggagggaccaagttgaccgtccttggtcagcccaaggctgccccctcggtcactctcg

SEQ ID NO: 586628 - DNA, 503 bp, Homo sapiens
  misc_feature: HIJSMM301DI9O3.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacaggacttcacttctcaccatcaccagactggagcctgaagattttgcagtgtattattgtcagcagtatggtagcgcaccgtacacttttggccaggggtccaagctggagatgaaacgaactgtggctgcaccatctgtcttcatcttccccg

SEQ ID NO: 586629 - DNA, 499 bp, Homo sapiens
  misc_feature: HIJSMM301EOVNA.13.19.B08.1.454.light.4.raw
tcacgtactacacgaccggtgctcgatttagtgagtcagtaaggggaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctgccccctcggtcactctgttccgccctcctct

SEQ ID NO: 586630 - DNA, 498 bp, Homo sapiens
  misc_feature: HIJSMM301EV32A.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcgggggaccgaagactggagatcaaccgaactagtggctgcacactctgtt

SEQ ID NO: 586631 - DNA, 494 bp, Homo sapiens; identical to SEQ ID NO: 534994
  misc_feature: HIJSMM301DWJCU.27.78.H01.1.454.light.4.raw

SEQ ID NO: 586632 - DNA, 497 bp, Homo sapiens; identical to SEQ ID NO: 535286
  misc_feature: HIJSMM301CW93E.18.59.F04.1.454.light.4.raw

SEQ ID NO: 586633 - DNA, 511 bp, Homo sapiens
  misc_feature: HIJSMM301DKRVC.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccagggggaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggccgtccgggggccactttcggcccgtgggaccgaaggtggagatcaaacgaactgtggctgcaccatctgtcttcta

SEQ ID NO: 586634 - DNA, 503 bp, Homo sapiens; identical to SEQ ID NO: 555460
  misc_feature: HIJSMM301DDWEK.8.42.D09.1.454.light.4.raw

SEQ ID NO: 586635 - DNA, 521 bp, Homo sapiens; identical to SEQ ID NO: 538715
  misc_feature: HIJSMM301EG78X.27.23.C01.1.454.light.4.raw

SEQ ID NO: 586636 - DNA, 495 bp, Homo sapiens; identical to SEQ ID NO: 535596
  misc_feature: HIJSMM301AI41I.10.79.H02.1.454.light.4.raw

SEQ ID NO: 586637 - DNA, 503 bp, Homo sapiens
  misc_feature: HIJSMM301CMPBR.3.4.A04.1.454.light.4.raw
agacgcactccacgaccggtgctcgatttagagtagtgatcaggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtcaaagcctcgtatacagtgatggaaacacctacttgaattggtttcagcagaggccaggccaatctccaaggcgcctaatttataaggtttctaaccgggactctggggtcccagacagattcagcggcagtgggtcaggcactgatttcacactgaaaatcagcagggtggaggctgaggatgttggggtttattactgcatgcaaggtacacactggcctccgacgttcggccacgggaccaaggtggaaatcaaacgaactagtggctgcaccatctgtcttcta

SEQ ID NO: 586638 - DNA, 509 bp, Homo sapiens
  misc_feature: HIJSMM301CUUVE.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggacccaggtggagatcagactgatattaacagcgaaaagagatttttgtaagggaagtaatgaagttaa

SEQ ID NO: 586639 - DNA, 474 bp, Homo sapiens; identical to SEQ ID NO: 561309
  misc_feature: HIJSMM301AP3VK.5.12.B01.1.454.light.4.raw

SEQ ID NO: 586640 - DNA, 493 bp, Homo sapiens; identical to SEQ ID NO: 538503
  misc_feature: HIJSMM301EVO4H.9.1.A01.1.454.light.4.raw

SEQ ID NO: 586641 - DNA, 486 bp, Homo sapiens; identical to SEQ ID NO: 540241
  misc_feature: HIJSMM301DSFS8.46.26.C04.1.454.light.4.raw

SEQ ID NO: 586642 - DNA, 494 bp, Homo sapiens; identical to SEQ ID NO: 534992
  misc_feature: HIJSMM301DVUSV.9.1.A01.1.454.light.4.raw

SEQ ID NO: 586643 - DNA, 492 bp, Homo sapiens; identical to SEQ ID NO: 535392
  misc_feature: HIJSMM301BQA2L.40.81.H04.1.454.light.4.raw

SEQ ID NO: 586644 - DNA, 439 bp, Homo sapiens
  misc_feature: HIJSMM301B55LD.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccatcactgggctccagcctgaggatgaggctgattattactgtcagtcctttgacattaaactggatgtggtattcggcggagggacccacgtaaccgtcctaggtcagcccaaggctgccccctcggtcactctgttccccctcctcgtatctctcg

SEQ ID NO: 586645 - DNA, 473 bp, Homo sapiens; identical to SEQ ID NO: 535262
  misc_feature: HIJSMM301A3E4V.8.67.G01.1.454.light.4.raw

SEQ ID NO: 586646 - DNA, 493 bp, Homo sapiens; identical to SEQ ID NO: 544335
  misc_feature: HIJSMM301BMMT8.5.57.F02.1.454.light.4.raw

SEQ ID NO: 586647 - DNA, 507 bp, Homo sapiens; identical to SEQ ID NO: 559588
  misc_feature: HIJSMM301AXU6Q.19.78.H01.1.454.light.4.raw

SEQ ID NO: 586648 - DNA, 493 bp, Homo sapiens
  misc_feature: HIJSMM301CH41J.48.1.A01.1.454.light.4.raw
agtatacatacacgaccggtgctcgatttagacgtctcatcagggggcaggagtcagacccagtcaggactcagcatggacatgagggtccccgctcagctcctggggctcctgctgctctggttcccaggttccagatgcgacatccagatgacccagtctccatcttccgtgtctgcttctgtcggagacagagtcactatcacttgtcgggcgagccaggatgttagtcccttattagcctggtatcagcagaaaccagggaaagccccgaagctcctaattttcgctgtctccagtttgcagagtggagtcccatctcggttcagcggcagtggatctggggcagagttcattctcaccatcaacagccttcagcctgaagattttgcaacttactattgtcagcagggtgacagtttccctcccactttcggcggagggaccagggtggacgtcaaacgaactggtggctgcaccatctgtcttcatt

SEQ ID NO: 586649 - DNA, 497 bp, Homo sapiens; identical to SEQ ID NO: 536371
  misc_feature: HIJSMM301DWT9K.16.78.H01.1.454.light.4.raw

SEQ ID NO: 586650 - DNA, 404 bp, Homo sapiens; identical to SEQ ID NO: 535530
  misc_feature: HIJSMM301CRYHT.4.35.D02.1.454.light.4.raw

SEQ ID NO: 586651 - DNA, 500 bp, Homo sapiens
  misc_feature: HIJSMM301CWHE6.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggt

SEQ ID NO: 586652 - DNA, 518 bp, Homo sapiens; identical to SEQ ID NO: 581602
  misc_feature: HIJSMM301ANA2R.3.87.H10.1.454.light.4.raw

SEQ ID NO: 586653 - DNA, 494 bp, Homo sapiens; identical to SEQ ID NO: 537091
  misc_feature: HIJSMM301AN3FG.27.78.H01.1.454.light.4.raw
  modified_base (426)..(426): a, c, t, g, unknown or other

SEQ ID NO: 586654 - DNA, 441 bp, Homo sapiens; identical to SEQ ID NO: 534971
  misc_feature: HIJSMM301CROC6.11.3.A03.1.454.light.4.raw

SEQ ID NO: 586655 - DNA, 501 bp, Homo sapiens; identical to SEQ ID NO: 535746
  misc_feature: HIJSMM301EU7LD.18.11.A11.1.454.light.4.raw

SEQ ID NO: 586656 - DNA, 477 bp, Homo sapiens; identical to SEQ ID NO: 543681
  misc_feature: HIJSMM301CMTO7.3.82.H05.1.454.light.4.raw

SEQ ID NO: 586657 - DNA, 486 bp, Homo sapiens; identical to SEQ ID NO: 583050
  misc_feature: HIJSMM301BXKXP.47.70.G04.1.454.light.4.raw

SEQ ID NO: 586658 - DNA, 490 bp, Homo sapiens
  misc_feature: HIJSMM301C58JL.17.34.D01.1.454.light.4.raw
cgtagactagcacgaccggtgctcgatttagatcgtctgtgttgggtttgggtcatcacaatatctgcactggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaatttattactgtatgcaaggtatagagcttcctccgacgttcggccaagggaccaaggtaggaacgtacaaacgaactgtggctgcaccatctgtcttcatcttcccgtcccatctgatacgtcttacg

SEQ ID NO: 586659 - DNA, 493 bp, Homo sapiens; identical to SEQ ID NO: 535047
  misc_feature: HIJSMM301CQITM.16.53.E09.1.454.light.4.raw

SEQ ID NO: 586660 - DNA, 510 bp, Homo sapiens; identical to SEQ ID NO: 538614
  misc_feature: HIJSMM301D9DGO.19.59.F04.1.454.light.4.raw

SEQ ID NO: 586661 - DNA, 491 bp, Homo sapiens
  misc_feature: HIJSMM301AN66I.13.5.A05.1.454.light.4.raw
tcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctcccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaatattatagtactcctccgaggctcactttcggcggagggaccaaggtggagatcaaacgaactgt

SEQ ID NO: 586662 - DNA, 482 bp, Homo sapiens
  misc_feature: HIJSMM301AOMEG.26.78.H01.1.454.light.4.raw
agactatactcacgaccggtgctcgatttagtgtgagtagtttgggtttggggcagagccctggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgagattttgcactttattactgtcagcagcgtagcaactggcctctcactttcggcggagggaccagggtggagatcagacgaa

SEQ ID NO: 586663 - DNA, 504 bp, Homo sapiens
  misc_feature: HIJSMM301DS9CA.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactattaaattggtatcaacaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaagggaccaaggtggaggatcaaacgaactgtggctgcaccatctgtcttcatcttcccgccat

SEQ ID NO: 586664 - DNA, 485 bp, Homo sapiens; identical to SEQ ID NO: 536630
  misc_feature: HIJSMM301AGEFU.13.56.F01.1.454.light.4.raw

SEQ ID NO: 586665 - DNA, 574 bp, Homo sapiens
  misc_feature: HIJSMM301BDXO3.43.69.G03.1.454.light.4.raw
tgtgagtagtcacgaccggtgctcgatttagtcgctgcgtaaaggagaaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagacgagtaacgacgacgactaggttcgttaccttacggttcggggtttcgggttcggggggacccgggggaaccgaacgtcgtaccggtaccccgttacggttacggtaccgaccgaacccggaacggtccgtccccgtcccccggtccggtcctacctttccc

SEQ ID NO: 586666 - DNA, 502 bp, Homo sapiens; identical to SEQ ID NO: 559752
  misc_feature: HIJSMM301AOCWA.2.35.D02.1.454.light.4.raw

SEQ ID NO: 586667 - DNA, 486 bp, Homo sapiens; identical to SEQ ID NO: 535385
  misc_feature: HIJSMM301DMGTS.19.71.G05.1.454.light.4.raw

SEQ ID NO: 586668 - DNA, 469 bp, Homo sapiens; identical to SEQ ID NO: 536091
  misc_feature: HIJSMM301CXI34.3.82.H05.1.454.light.4.raw

SEQ ID NO: 586669 - DNA, 482 bp, Homo sapiens; identical to SEQ ID NO: 539800
  misc_feature: HIJSMM301AG5NU.21.25.C03.1.454.light.4.raw

SEQ ID NO: 586670 - DNA, 485 bp, Homo sapiens; identical to SEQ ID NO: 545589
  misc_feature: HIJSMM301EI2T8.26.70.G04.1.454.light.4.raw

SEQ ID NO: 586671 - DNA, 494 bp, Homo sapiens; identical to SEQ ID NO: 534992
  misc_feature: HIJSMM301DL2R9.9.1.A01.1.454.light.4.raw

SEQ ID NO: 586672 - DNA, 503 bp, Homo sapiens
  misc_feature: HIJSMM301BU0AP.4.57.F02.1.454.light.4.raw
  modified_base (418)..(418): a, c, t, g, unknown or other
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactatactgtcaggtgtgggntagtagtggtgatcatcatacgtcttcggaactgggaccaaggtctccgtcctacgtcagcccaaggccaactccactgtcactc

SEQ ID NO: 586673 - DNA, 486 bp, Homo sapiens
  misc_feature: HIJSMM301C3OZO.48.38.D05.1.454.light.4.raw
agtatacatacacgaccggtgctcgatttagtatctgatagttgggtttggaggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctcg

SEQ ID NO: 586674 - DNA, 517 bp, Homo sapiens
  misc_feature: HIJSMM301EORYO.9.20.B09.1.454.light.4.raw
tgatacgtctcacgaccggtgctcgatttagtgtagtgtgaaggggctgggcctaaggaagcagcactggtggtgcctcagccatggcctggaccgttctcctcctcggcctcctctctcactgcacaggatctatgacctcacatgtgctgactcagccaccctcggtgtcagtggccccaggagggacggccaccattacctgtgtgggagaagacattgcaaggaagagtgtccactggtaccaacagaggccaggccgggcccctgtggtggtcgtctatgataacagtgaccggccctcgtcgatccctgagcgcttctctggctccaactctgggaacacggccaccctgaccatcagcagggccgaagccggggatgaggccgactattactgccaggtgtggcatattatcacccccgtgttcggcgggggaccaagctgaccgtcctaggtcagcccaaggctcgccccctcggtcactctcgttccccaccctcctccagacgtatc

SEQ ID NO: 586675 - DNA, 496 bp, Homo sapiens; identical to SEQ ID NO: 536248
  misc_feature: HIJSMM301B794V.22.27.C05.1.454.light.4.raw

SEQ ID NO: 586676 - DNA, 467 bp, Homo sapiens
  misc_feature: HIJSMM301C45MD.48.41.D08.1.454.light.4.raw
agtatacatacacgaccggtgctcgatttagtcacgcgagaaagggaaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgatatgtatact

SEQ ID NO: 586677 - DNA, 486 bp, Homo sapiens; identical to SEQ ID NO: 535043
  misc_feature: HIJSMM301DK4U4.46.35.D02.1.454.light.4.raw

SEQ ID NO: 586678 - DNA, 488 bp, Homo sapiens
  misc_feature: HIJSMM301CPEBX.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaacgaactgtggctgcacta

SEQ ID NO: 586679 - DNA, 504 bp, Homo sapiens; identical to SEQ ID NO: 537659
  misc_feature: HIJSMM301D1M4W.13.55.E11.1.454.light.4.raw

SEQ ID NO: 586680 - DNA, 518 bp, Homo sapiens
  misc_feature: HIJSMM301BG3IJ.41.19.B08.1.454.light.4.raw
  modified_base (512)..(512): a, c, t, g, unknown or other
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaacccactgtcactctgttcccncctcct

SEQ ID NO: 586681 - DNA, 505 bp, Homo sapiens; identical to SEQ ID NO: 536117
  misc_feature: HIJSMM301BCL8I.8.71.G05.1.454.light.4.raw

SEQ ID NO: 586682 - DNA, 486 bp, Homo sapiens
  misc_feature: HIJSMM301DEGGQ.46.35.D02.1.454.light.4.raw
  modified_base (461)..(461): a, c, t, g, unknown or other
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctgganatcaaacgaactgtggctgcaccat

SEQ ID NO: 586683 - DNA, 484 bp, Homo sapiens; identical to SEQ ID NO: 540581
  misc_feature: HIJSMM301B50PN.3.88.H11.1.454.light.4.raw

SEQ ID NO: 586684 - DNA, 496 bp, Homo sapiens; identical to SEQ ID NO: 541772
  misc_feature: HIJSMM301B9PS1.51.81.H04.1.454.light.4.raw

SEQ ID NO: 586685 - DNA, 498 bp, Homo sapiens
  misc_feature: HIJSMM301CBM0W.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggaggggaccaaggtggagatacaaacgaactgt

SEQ ID NO: 586686 - DNA, 496 bp, Homo sapiens; identical to SEQ ID NO: 556037
  misc_feature: HIJSMM301AWR8Y.41.38.D05.1.454.light.4.raw

SEQ ID NO: 586687 - DNA, 522 bp, Homo sapiens
  misc_feature: HIJSMM301CCQFG.47.53.E09.1.454.light.4.raw
agctcacgtacacgaccggtgctcgatttagagagagtgtgttgggtttggggctgggcctaaggaagcagcactggtggtgcctcagccatggcctggaccgttctcctcctcggcctcctctctcactgcacaggctctgtgacgtccgacgagctgattcaggcaccctcgatgtcagtggccccaggacagacggccaggattacttgtgcgggagccagtgttggagaaagaagtgtacactggtaccaacagatgccaggccaggcccctgtgctggtcgtctatgatgatagtgaccggccctctgggatccccgagcgattctctggctccaagtctgggaacacggccaccctgaccgtcagcagggtcgacgtcggggatgaggccgtatattttgtcaggtggtgggagactaattttggttcatatgttgttcggcggagggaccgaagctgaccgtcctcggtcagcccaaggctcgccccctccggtcactctgttccctaccctcct

SEQ ID NO: 586688 - DNA, 504 bp, Homo sapiens
  misc_feature: HIJSMM301AH5AX.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagccaaggctgccccctcggtcactctgttcccaccctcct

SEQ ID NO: 586689 - DNA, 504 bp, Homo sapiens
  misc_feature: HIJSMM301C3MWV.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagatttgcagtttattactgtcagcagcgggcaattggccgctcacttcggcgggggaccgaaggtggagttcaaacgaactgtggcgtgcaccatctgtcttcatccttcccgccta

SEQ ID NO: 586690 - DNA, 505 bp, Homo sapiens
  misc_feature: HIJSMM301AT6M2.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccaaagtggatatcaaacgaactagtggctgcaccatctgtcttctatt

SEQ ID NO: 586691 - DNA, 473 bp, Homo sapiens; identical to SEQ ID NO: 565025
  misc_feature: HIJSMM301C5W7C.5.34.D01.1.454.light.4.raw

SEQ ID NO: 586692 - DNA, 502 bp, Homo sapiens; identical to SEQ ID NO: 541971
  misc_feature: HIJSMM301DU4GN.4.39.D06.1.454.light.4.raw

SEQ ID NO: 586693 - DNA, 505 bp, Homo sapiens
  misc_feature: HIJSMM301DQTUK.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaaggaccaggtgaagtcaagcgaactgtggctgcaccatctgtcttcatcttcccgcc

SEQ ID NO: 586694 - DNA, 490 bp, Homo sapiens
  misc_feature: HIJSMM301EC61W.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagtttacagttacccccctcactttcggcggagggaccaaggcggagatcgagacgaactgtgctgcacatctgtcttcta

SEQ ID NO: 586695 - DNA, 495 bp, Homo sapiens; identical to SEQ ID NO: 538269
  misc_feature: HIJSMM301DE40Q.9.1.A01.1.454.light.4.raw

SEQ ID NO: 586696 - DNA, 481 bp, Homo sapiens
  misc_feature: HIJSMM301ERP6A.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccagggaccgaaacgtaggagtagtcaaccgaactcgtggctgcacca

SEQ ID NO: 586697 - DNA, 503 bp, Homo sapiens
  misc_feature: HIJSMM301B2S00.2.49.E05.1.454.light.4.raw
acgctcgacacacgaccggtgctcgatttagagcgactagcaacacacaaaggggggggaagctcagcttcagctgtggtagagaagacaggattcaggacaatctccagcatggccggcttccctctcctcctcaccctcctcactcactgtgcagggtcctgggcccagtctgtgctgactcagccaccctcagcgtctggtacccccgggcagagggtcaccatctcttgttctggaagcatgtccaacatcggaagtgataatgtatactggtaccagcagttcccaagagcggcccccaagctcctcatctatagaaattatgaacggtcctcaggggtccctgaccgattctctggctccaagtctggcacctcagcctccctggccatcagtgggctccggtccgaggatgaggctgattattactgttgttggatgggacagcagcctgagtgcttatgtcttcgggaactgggaccacggtcaccgtcctaggt

SEQ ID NO: 586698 - DNA, 521 bp, Homo sapiens; identical to SEQ ID NO: 538715
  misc_feature: HIJSMM301DUJW3.27.23.C01.1.454.light.4.raw

SEQ ID NO: 586699 - DNA, 460 bp, Homo sapiens; identical to SEQ ID NO: 536053
  misc_feature: HIJSMM301BKSYZ.22.28.C06.1.454.light.4.raw

SEQ ID NO: 586700 - DNA, 474 bp, Homo sapiens; identical to SEQ ID NO: 553218
  misc_feature: HIJSMM301B763U.8.67.G01.1.454.light.4.raw

SEQ ID NO: 586701 - DNA, 527 bp, Homo sapiens
  misc_feature: HIJSMM301B8KQW.16.59.F04.1.454.light.4.raw
tgtactactccacgaccggtgctcgatttagtacacacacttagggattggggggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggagctgtcaccaatggtcattatccctactggttccaacagaagcctggccaagcccccaggacactgatttatgatacaaacaacaaacactcctggacccctgcccggttctcaggctccctcgttggggacaaagctgccctgaccctttcgggtgcgcagcctgaggatgaggctgagtattactgcttgctctcctatagtggtgttcgggtgttcggcggagggaccaagctgaccgtctaggtcagcccaaggctgccccctcggtcactctgttctcacccctcctcgagtagtactac

SEQ ID NO: 586702 - DNA, 481 bp, Homo sapiens
  misc_feature: HIJSMM301C2GZB.4.10.A10.1.454.light.4.raw
agcactgtagcacgaccggtgctcgatttagcgtcgatctcaggggagtcccagtcaggacacagcatggacatgagggtccccgttcagctcctggggctcctgctgctctggctcccaggtgccagatgtgccatccagttgacccagtctccatcctccctgtctgcatctataggagacagagtcaccatcacttgccgggccagtcagggcattttcagttatttagcctggtatcagcaaaaaccagggaaagcccctaagctcctgatctatggtgcatccactttgcaaagtggggtcccatcaaggttcagcggcagtggatctgggacagatttcactctcaccatcagcagcctacagcctgaagattttgcaacttattactgtcaacagcttaataattacgcgctcactttcggcgagggaccaaggtggagatcaaacgaactgtggctgcaccatctgtcttcta

SEQ ID NO: 586703 - DNA, 454 bp, Homo sapiens; identical to SEQ ID NO: 535005
  misc_feature: HIJSMM301BM2W6.19.86.H09.1.454.light.4.raw

SEQ ID NO: 586704 - DNA, 489 bp, Homo sapiens
  misc_feature: HIJSMM301BRJ8P.52.23.C01.1.454.light.4.raw
cgcagtacgacacgaccggtgctcgatttagtacacgtgattagggattgggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacatttttactttcaccatcagcggcctgcagcctgaagattttgcaacatattactgtcaacaatatgaagatctccccctcactttcggcggagggaccaaggtggagatcagacgaactgtggctgcaccta

SEQ ID NO: 586705 - DNA, 448 bp, Homo sapiens; identical to SEQ ID NO: 540364
  misc_feature: HIJSMM301CS3AE.18.9.A09.1.454.light.4.raw

SEQ ID NO: 586706 - DNA, 460 bp, Homo sapiens; identical to SEQ ID NO: 537107
  misc_feature: HIJSMM301DMCCO.22.28.C06.1.454.light.4.raw

SEQ ID NO: 586707 - DNA, 496 bp, Homo sapiens; identical to SEQ ID NO: 538149
  misc_feature: HIJSMM301CAAYG.13.67.G01.1.454.light.4.raw

SEQ ID NO: 586708 - DNA, 486 bp, Homo sapiens; identical to SEQ ID NO: 535043
  misc_feature: HIJSMM301B9IU3.46.35.D02.1.454.light.4.raw

SEQ ID NO: 586709 - DNA, 518 bp, Homo sapiens
  misc_feature: HIJSMM301CL6DD.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctcgttcccgccctcctccgt

SEQ ID NO: 586710 - DNA, 515 bp, Homo sapiens
  misc_feature: HIJSMM301BI9PB.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctcctccttggggcaaagctgccctgacactgtctggtgtgcagcctgaggacgaggctgactattactgcctactctactttggtggtgctgtgctattcggcggagggaccaagctgaccgtcttaagtcagcccaaggcctgccccctggtcactctcgttcccaccctcctcc

SEQ ID NO: 586711 - DNA, 493 bp, Homo sapiens
  misc_feature: HIJSMM301CCE0U.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgcagtttattactgtcagcagtataataactggttcctgctcactttcggcgggggaccgaaggtggagatcaaacgaactgtggctgcacatctgtt

SEQ ID NO: 586712 - DNA, 483 bp, Homo sapiens; identical to SEQ ID NO: 535777
  misc_feature: HIJSMM301CAUAC.10.1.A01.1.454.light.4.raw

SEQ ID NO: 586713 - DNA, 484 bp, Homo sapiens
  misc_feature: HIJSMM301BJD3I.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagtctggtatcagcagaagccagggagagtccctaaattattgatctctgctgcgtcgccttgcaatcgggggtcccatctcggttcagtggcggtggatctaggacagaattcactctcaccatcaccaacctgcaccctgaagatgttggaagttattactgtcagacctatagtggtggcccgctcattttcggcggtagggaccaaggtgcagatcaaacgaactgtggctgca

SEQ ID NO: 586714 - DNA, 478 bp, Homo sapiens; identical to SEQ ID NO: 540986
  misc_feature: HIJSMM301BS9V6.16.86.H09.1.454.light.4.raw

SEQ ID NO: 586715 - DNA, 489 bp, Homo sapiens; identical to SEQ ID NO: 535139
  misc_feature: HIJSMM301DOLC1.14.55.E11.1.454.light.4.raw

SEQ ID NO: 586716 - DNA, 491 bp, Homo sapiens
  misc_feature: HIJSMM301AED5A.4.27.C05.1.454.light.4.raw
agcactgtagcacgaccggtgctcgatttagacgcgatcgaagggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaaccgggcctccggggtccctgacaggttcagtggcagtggatcaggcacagattttacactgagaatcagcagagtggaggctgaggatgttggggtttactactgcatgcaagctctacaagccacctacacttttggtccaggggaccgaggctggaggatcaaacgaactagt

SEQ ID NO: 586717 - DNA, 475 bp, Homo sapiens
  misc_feature: HIJSMM301BJOI8.48.2.A02.1.454.light.4.raw
agtatacatacacgaccggtgctcgatttagactcatctacaggggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccgagggaaagcccctaagctcctgatctatgctgcatcctactttgacaaaatgggtcccatcgagattcagcggcagtggatctggcacagagttcactctcaccatcagcaccctgcagcctgaagtatttgcgtacttattctgtctacaagattctaatacccttacgacggttcgccgacgggacgaaacgtggagtgtcaaccgaacctgtgg

SEQ ID NO: 586718 - DNA, 521 bp, Homo sapiens; identical to SEQ ID NO: 538715
  misc_feature: HIJSMM301D36EE.27.23.C01.1.454.light.4.raw

SEQ ID NO: 586719 - DNA, 472 bp, Homo sapiens
  misc_feature: HIJSMM301DR8OQ.13.48.E04.1.454.light.4.raw
tcacgtactacacgaccggtgctcgatttagagagcgtcacagagagaagggggcaggagtcagacccactcaggacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcagggcattagaaatgatttaggctggtatcagcagaaaccagggaaagcccctaagctcttgatctatggtgcatccagtttaaaaagtggggtcccatcaaggttcagcggcagtggatctggcacagacttcattctcaccatcagcagcctgcagcctgaagattttgcaacttattactgtctacaagatcacaattatcctgggacgttcggccaggaccaaggtggaaatacaaacgaa

SEQ ID NO: 586720 - DNA, 485 bp, Homo sapiens
  misc_feature: HIJSMM301C3BRF.43.36.D03.1.454.light.4.raw
tgtgagtagtcacgaccggtgctcgatttagctgcgtcacgatctctcttggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtatccccccacccatcagcacgccttagcctggtaccagcacaagtcagggcagcctcctaagttgctctttactggacttcgatccgcgcatctggggtccctgaccgattcatgggcagcggctctgggacagacttcgctctcaccatcaacagcctccaggctgaggatgcggcggtttattattgtcaacaatattttagtgctccgtacacttttggccaggggaccaagttggagatcaaacgaa

SEQ ID NO: 586721 - DNA, 501 bp, Homo sapiens; identical to SEQ ID NO: 542520
  misc_feature: HIJSMM301B3U0M.10.43.D10.1.454.light.4.raw

SEQ ID NO: 586722 - DNA, 497 bp, Homo sapiens; identical to SEQ ID NO: 535286
  misc_feature: HIJSMM301ADJ41.18.59.F04.1.454.light.4.raw

SEQ ID NO: 586723 - DNA, 497 bp, Homo sapiens
  misc_feature: HIJSMM301C73RU.9.75.G09.1.454.light.4.raw
  modified_base (472)..(472): a, c, t, g, unknown or other
tgatacgtctcacgaccggtgctcgatttagtatagacatcagggggtcagacccagtcaggacacagcgtggacatgagggtccccgctcagctcctggggctcctgctgctctggctcccaggtgccaattgtgacatccagatgacccagtctccttccaccctgtctgcatctgtgggagacagagtcaccatctcttgccgggccagtcagaatgttcttagttggttggcctggtatcagcagaaaccggggaaagcccctaaactcttgatctatgaggcctctggtttacaaagtgggtcccatcaagattcagtggcagcgggtctgggacagatttcactctcaccatcagcagcctgcaggctgaagatgtggcagtttattactgtcaacagtttcttcgggcgttcggccaaggaccgaaggtggaaagtacaaacgaactagtggctgcaccaatctntcttcatcttcccgtcccactcctg

SEQ ID NO: 586724 - DNA, 485 bp, Homo sapiens; identical to SEQ ID NO: 538533
  misc_feature: HIJSMM301BYYG8.47.78.H01.1.454.light.4.raw

SEQ ID NO: 586725 - DNA, 491 bp, Homo sapiens; identical to SEQ ID NO: 543478
  misc_feature: HIJSMM301EU4MX.14.55.E11.1.454.light.4.raw

SEQ ID NO: 586726 - DNA, 556 bp, Homo sapiens
  misc_feature: HIJSMM301ANZG1.17.25.C03.1.454.light.4.raw
cgtagactagcacgaccggtgctcgatttagtagtgtagatttgggtttggggtacgatttgatgttacctgatgcttagaggcttttcctggaagcagggcatttgttgcttcagcaccgtagtgcctcgtcatcacgcctcagccttgattttccggatttgcctggaaaaccagcctacacgcttaaaccgggacaaccgtcgcccggccaacatagccttctccgtccccccttcgcagtaacaccaagtacaggaatattaacctgtttcccatcgactacgcctttcggcctcgccttaggggtcgactcaccctgccccgattaacgttggacaggaacccttggtcttccggcgagcggggcttttcgacccgcgtttatcgttacttatgtcagcattcgcacttctgatacctccagcatgcctcacagcacaccttcacaggcttacagaacgctcccctacccaacaacgcataagcgtcgctgccgcagcttcggtgcatggtttagccccgtttcatcttcccgccatctgactagtctacg

SEQ ID NO: 586727 - DNA, 501 bp, Homo sapiens
  misc_feature: HIJSMM301A0ATB.15.1.A01.1.454.light.4.raw
  modified_base (475)..(475): a, c, t, g, unknown or other
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtnagcccaaggctgccccctcggtcact

SEQ ID NO: 586728 - DNA, 504 bp, Homo sapiens; identical to SEQ ID NO: 535561
  misc_feature: HIJSMM301DENUQ.4.57.F02.1.454.light.4.raw

SEQ ID NO: 586729 - DNA, 492 bp, Homo sapiens
  misc_feature: HIJSMM301DWTKI.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgcaacttatttttgtcaacaggctaacactttccccctcactttcggcggagggaccaaggtaggagatcaagcgaactgtggctgcaccatctgtctt

SEQ ID NO: 586730 - DNA, 502 bp, Homo sapiens; identical to SEQ ID NO: 543936
  misc_feature: HIJSMM301C4FJR.15.1.A01.1.454.light.4.raw

SEQ ID NO: 586731 - DNA, 500 bp, Homo sapiens
  misc_feature: HIJSMM301AZLRC.41.11.A11.1.454.light.4.raw
tctatactatcacgaccggtgctcgatttagctacgactgcagggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcgggtaacgttttggtccgaggggaccgaacgactggagatacagacgaactgtggctgcaccatctgtcttcta

SEQ ID NO: 586732 - DNA, 508 bp, Homo sapiens
  misc_feature: HIJSMM301DRMU6.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaatagtactactcctgtggttttcggcggagggaccaagctgaccgtcctaggtcagcccaaggctgccccctcggtcactctgtt

SEQ ID NO: 586733 - DNA, 486 bp, Homo sapiens; identical to SEQ ID NO: 540241
  misc_feature: HIJSMM301EOI2V.46.26.C04.1.454.light.4.raw

SEQ ID NO: 586734 - DNA, 485 bp, Homo sapiens; identical to SEQ ID NO: 536075
  misc_feature: HIJSMM301EXDQH.17.21.B10.1.454.light.4.raw

SEQ ID NO: 586735 - DNA, 473 bp, Homo sapiens
  misc_feature: HIJSMM301DKMP8.49.73.G07.1.454.light.4.raw
agtcgagagacacgaccggtgctcgatttagctctacgctcagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcgtgtatctgaattggtatcagcaaaaaccagggaaagcccctgagctcctgatcctcgatgcatccaatttggaaacaggggtcccatcgaggttctctggaagtggctctgggacacattttactttctaccatcagcagactgcagcctgaagatattgcaacatattactgtcaacagtatgataatctccgctcactttcggtcggagggaccaaggtggagagtcaaacgaactagt

SEQ ID NO: 586736 - DNA, 487 bp, Homo sapiens; identical to SEQ ID NO: 539014
  misc_feature: HIJSMM301CTUIA.52.3.A03.1.454.light.4.raw

SEQ ID NO: 586737 - DNA, 509 bp, Homo sapiens
  misc_feature: HIJSMM301D7XFR.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccgaagggaccaaggtaggaaagtacaaacgaactagtggctgcgaccatctgtcttctatcttccccg

SEQ ID NO: 586738 - DNA, 455 bp, Homo sapiens; identical to SEQ ID NO: 555402
  misc_feature: HIJSMM301B9VVL.5.86.H09.1.454.light.4.raw

SEQ ID NO: 586739 - DNA, 491 bp, Homo sapiens
  misc_feature: HIJSMM301BH4FU.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatctgtcttcatccttcccgcc

SEQ ID NO: 586740 - DNA, 507 bp, Homo sapiens
  misc_feature: HIJSMM301BKRK8.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggcctgccccctggtcactctcgttcccgccctcctcga

SEQ ID NO: 586741 - DNA, 511 bp, Homo sapiens
  misc_feature: HIJSMM301A1GFM.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattaactgtcaacaatttcgttatactccgccgacgttcgccgggggaccgaccgtggaaagtcaaacgaactagtggctgcaccatctgtctt

SEQ ID NO: 586742 - DNA, 362 bp, Homo sapiens
  misc_feature: HIJSMM301CN72P.3.57.F02.1.454.light.4.raw
agacgcactccacgaccggtgctcgatttagctcgatatagttgggtttggggggtgtggtggtctccactcccgccttgacggggctgctatctgccttccaggcccctatcctggtcatcaattatgacagcgaccggccctcagggatccctgagcgattctctggctccaactctgggaacacggccaccctgaccatcaccagggtcgaggccgaggatgaggccgactattactgtcaggtgtgggatagccgttctgatcattgggtcttcggcggcgggaccaagctgaccgtcctatgtcaacccaaggctggcccctcggtcactctgttcccaccctcctcgagtgcgtct

SEQ ID NO: 586743 - DNA, 487 bp, Homo sapiens; identical to SEQ ID NO: 536025
  misc_feature: HIJSMM301AG8L4.17.34.D01.1.454.light.4.raw

SEQ ID NO: 586744 - DNA, 494 bp, Homo sapiens; identical to SEQ ID NO: 534992
  misc_feature: HIJSMM301C0SOW.9.1.A01.1.454.light.4.raw

SEQ ID NO: 586745 - DNA, 493 bp, Homo sapiens
  misc_feature: HIJSMM301AKWJW.49.53.E09.1.454.light.4.raw
agtcgagagacacgaccggtgctcgatttagagagagtgtgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccagtttcagtggcagtgggtctgggacagacttcactctcaccatcagcagcctagagcctgaagattttgcagtctattactgtcagcagcgttacaactggcctcccatgtacacttttggccaggggaccgaagctggaaatcagacgaactgtggctgcaccat

SEQ ID NO: 586746 - DNA, 491 bp, Homo sapiens; identical to SEQ ID NO: 550951
  misc_feature: HIJSMM301AMTUE.17.21.B10.1.454.light.4.raw

SEQ ID NO: 586747 - DNA, 495 bp, Homo sapiens
  misc_feature: HIJSMM301BFICI.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttggccaagggacacgactggagattaaaaggaaactgtggctgcaccatctgtcttcatcttccccg

SEQ ID NO: 586748 - DNA, 489 bp, Homo sapiens
  misc_feature: HIJSMM301AX8JL.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcgctctcaccgtcagcagtctgcaacctgaagtattttgcaacttactactgtcaacagagttacacgtacccccctcactttcggcgagggaccaggacggagatcagacgaactgtggctgcaccatctgtctcta

SEQ ID NO: 586749 - DNA, 497 bp, Homo sapiens
  misc_feature: HIJSMM301DAP4B.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgaccgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagccaaggctcgccccctc

SEQ ID NO: 586750 - DNA, 484 bp, Homo sapiens
  misc_feature: HIJSMM301CT91M.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggcggagggaccaaactgaccgtcctaggtcagcccaaggctgccccctcggtcactctgttcccaccctcctctactgagct

SEQ ID NO: 586751 - DNA, 498 bp, Homo sapiens
  misc_feature: HIJSMM301CKUFH.51.26.C04.1.454.light.4.raw
cgatcgtatacacgaccggtgctcgatttagtctagcgactttgggtttggggctgggcctcaggaagcagcatcggaggtgcctcagccatggcatggatccctctcttcctcggcgtccttgcttactgcacaggatccctggccgcctatgacctgactcagccaccctcagtgtccgtgtccccaggacagacagccaccatcacctgctctggagataattggggtctaagtatgtttcgtggtatcaacatcacccaggccggtccccgatactgctcctctatcatgatgccaagcggccctcagggatccctgagcgattctctggctccaactctggggacacagccactctgaccatccgcgggacccaggctgtggatgaggctgactattactgtcaggcgtgggacagggaggctgcgattttcggcggagggaccagtctgaccgtcctaggtcagcccaaggctgccccctcggtcactctcg

SEQ ID NO: 586752 - DNA, 476 bp, Homo sapiens
  misc_feature: HIJSMM301EHMU3.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctcctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaggcacttttggccaggggaccaaagctggagaggaaacgaactgtggctgcacat

SEQ ID NO: 586753 - DNA, 502 bp, Homo sapiens; identical to SEQ ID NO: 539002
  misc_feature: HIJSMM301DSUYT.18.59.F04.1.454.light.4.raw

SEQ ID NO: 586754 - DNA, 494 bp, Homo sapiens; identical to SEQ ID NO: 534994
  misc_feature: HIJSMM301BQX0R.27.78.H01.1.454.light.4.raw

SEQ ID NO: 586755 - DNA, 489 bp, Homo sapiens; identical to SEQ ID NO: 535386
  misc_feature: HIJSMM301EQX13.12.51.E07.1.454.light.4.raw

SEQ ID NO: 586756 - DNA, 500 bp, Homo sapiens
  misc_feature: HIJSMM301BILHE.9.21.B10.1.454.light.4.raw
tgatacgtctcacgaccggtgctcgatttagtgtcgtcgcaggaggagggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctgccccctc

SEQ ID NO: 586757 - DNA, 487 bp, Homo sapiens; identical to SEQ ID NO: 543396
  misc_feature: HIJSMM301DNHAY.46.26.C04.1.454.light.4.raw

SEQ ID NO: 586758 - DNA, 510 bp, Homo sapiens; identical to SEQ ID NO: 566324
  misc_feature: HIJSMM301AGFBH.5.60.F05.1.454.light.4.raw

SEQ ID NO: 586759 - DNA, 520 bp, Homo sapiens; identical to SEQ ID NO: 539176
  misc_feature: HIJSMM301AHSHN.27.23.C01.1.454.light.4.raw

SEQ ID NO: 586760 - DNA, 491 bp, Homo sapiens; identical to SEQ ID NO: 535294
  misc_feature: HIJSMM301CDC8U.16.68.G02.1.454.light.4.raw

SEQ ID NO: 586761 - DNA, 504 bp, Homo sapiens; identical to SEQ ID NO: 557936
  misc_feature: HIJSMM301EPDR3.19.78.H01.1.454.light.4.raw

SEQ ID NO: 586762 - DNA, 508 bp, Homo sapiens; identical to SEQ ID NO: 537871
  misc_feature: HIJSMM301CCEP1.8.33.C11.1.454.light.4.raw

SEQ ID NO: 586763 - DNA, 503 bp, Homo sapiens
  misc_feature: HIJSMM301C2T7L.40.67.G01.1.454.light.4.raw
  modified_base (434)..(434): a, c, t, g, unknown or other
tctagcgactcacgaccggtgctcgatttagagtatacatattgggtttgggggaggaactgctcagttaggacccagagggaaccatggaagccccagcccagcttctcttcctcctgctactctggctcccagcagccaccggagaagttgtcctgacacagtctccagccaccctgtccttgtctccagggcaaagagcctccctctcctgcggggccagtcagcatgttggcacctccttagcctggtaccaacaaaagcctggccaggctcccagactcctcatctatgatgcgtcttccagggccactggcgtcccggccaggttcagtggcagtgggtctgggacagccttcactctcaccatcagcagcctggagcccgaagattttgcggtttattactgtcagcagcgtgccgactggcccctnacgttcggcggagggaccaaggtggacatcaaacgactgtggctgcaccatctgtcttcatcttcccgc

SEQ ID NO: 586764 - DNA, 500 bp, Homo sapiens; identical to SEQ ID NO: 565246
  misc_feature: HIJSMM301C3WFS.48.22.B11.1.454.light.4.raw

SEQ ID NO: 586765 - DNA, 506 bp, Homo sapiens; identical to SEQ ID NO: 536038
  misc_feature: HIJSMM301AY79X.7.71.G05.1.454.light.4.raw

SEQ ID NO: 586766 - DNA, 504 bp, Homo sapiens; identical to SEQ ID NO: 540538
  misc_feature: HIJSMM301DRHMW.7.71.G05.1.454.light.4.raw

SEQ ID NO: 586767 - DNA, 493 bp, Homo sapiens; identical to SEQ ID NO: 538503
  misc_feature: HIJSMM301DP2RP.9.1.A01.1.454.light.4.raw

SEQ ID NO: 586768 - DNA, 502 bp, Homo sapiens; identical to SEQ ID NO: 536253
  misc_feature: HIJSMM301EZR3G.21.22.B11.1.454.light.4.raw

SEQ ID NO: 586769 - DNA, 505 bp, Homo sapiens; identical to SEQ ID NO: 546412
  misc_feature: HIJSMM301CFGQ2.22.21.B10.1.454.light.4.raw

SEQ ID NO: 586770 - DNA, 505 bp, Homo sapiens
  misc_feature: HIJSMM301E0CE9.17.27.C05.1.454.light.4.raw
cgtagactagcacgaccggtgctcgatttagacgcgatcgaagggtttggggagctgtgggctcagaagcagagttctggggtgtctccaccatggcctggacccctctctggctcactctcctcactctttgcataggttctgtggtttcttctgagctgactcaggatcctgctgtgtctgtggccttgggacagacagtcaggatcacatgccgaggagacagcctcagaagctattatgcaagttggtaccagcagaagccaggacaggcccctgtacttgtcatttatggtaagaataaccggccctcagggatcccagaccgattctctggctccgactcaggaaagacagccttccctgaccatcactggggctcaggcggaagatgaggctgactattactgtaactcccgggacagcagtgctgaccaggtggtattcgggcggagggacccactcgaccgtcttaggtcagcccaaggctcgccccctcggtcta

SEQ ID NO: 586771 - DNA, 491 bp, Homo sapiens
  misc_feature: HIJSMM301C6PA2.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcaggcactgaggtgttcggcggagggaccaagctgaccgtcctacgtcagcccaaggctcgccccctcc

SEQ ID NO: 586772 - DNA, 479 bp, Homo sapiens; identical to SEQ ID NO: 538734
  misc_feature: HIJSMM301AJFFV.8.53.E09.1.454.light.4.raw

SEQ ID NO: 586773 - DNA, 506 bp, Homo sapiens; identical to SEQ ID NO: 543993
  misc_feature: HIJSMM301BQHNL.18.78.H01.1.454.light.4.raw

SEQ ID NO: 586774 - DNA, 518 bp, Homo sapiens
  misc_feature: HIJSMM301EVT75.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcggggggactcagttgaccgtcctaggtcagcccaaggctgccccctcggtcactctgttcccgccctcctcacta

SEQ ID NO: 586775 - DNA, 508 bp, Homo sapiens
  misc_feature: HIJSMM301D5QVQ.10.88.H11.1.454.light.4.raw
catagtagtgcacgaccggtgctcgatttagcgacagcgagaacacacaaagggggaggaactgctcagttaggacccagagggaaccatggaagccccagctcagcttctcttcctcctgctactctggctcccaggtaccaccggagagattgtgttgacgcagtcgccagccaccctgtctttttctccaggggacagagtcaccctctcctgtagggccagttatggtgttggcgcctatttaaactggtaccaacagaaacgtggccaggctcccaggctcctcatctacgaagcatccaccagggccactggcgtcccagccaggttcgatggcagtgggtctgggacagacttcactctcaccatcagcagcctggagcctgaagatattgcagtttattattgtcagcagcgtagcaggtggcctttcactttcggcccggggaccaaagtggaaatcaaacgaactgtggctgcaccatctgtcttcatcttccgccat

SEQ ID NO: 586776 - DNA, 509 bp, Homo sapiens; identical to SEQ ID NO: 535670
  misc_feature: HIJSMM301BH39E.47.23.C01.1.454.light.4.raw

SEQ ID NO: 586777 - DNA, 493 bp, Homo sapiens
  misc_feature: HIJSMM301CCWZC.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcggcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcatcttccccg

SEQ ID NO: 586778 - DNA, 488 bp, Homo sapiens
  misc_feature: HIJSMM301BX4ZH.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgctaacttattattgtcaacaaagttatgagacccctgccactttcggccctgggaccatagtggatatagaaacgaactgtggctgcacc

SEQ ID NO: 586779 - DNA, 497 bp, Homo sapiens; identical to SEQ ID NO: 570022
  misc_feature: HIJSMM301AYUQT.51.23.C01.1.454.light.4.raw

SEQ ID NO: 586780 - DNA, 520 bp, Homo sapiens; identical to SEQ ID NO: 546218
  misc_feature: HIJSMM301DO1IC.12.71.G05.1.454.light.4.raw

SEQ ID NO: 586781 - DNA, 496 bp, Homo sapiens; identical to SEQ ID NO: 540287
  misc_feature: HIJSMM301EVBF3.40.11.A11.1.454.light.4.raw

SEQ ID NO: 586782 - DNA, 521 bp, Homo sapiens
  misc_feature: HIJSMM301D2RD5.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagtttatttctgtcagcagtctgaagactggccttctacttcggtcggacgggaccgaacggtagggaccgtaccaacgaaaccgtagtggcgtgcaccactctgtcttctactcttcccgtccca

SEQ ID NO: 586783 - DNA, 503 bp, Homo sapiens; identical to SEQ ID NO: 535044
  misc_feature: HIJSMM301DC3ER.19.78.H01.1.454.light.4.raw

SEQ ID NO: 586784 - DNA, 489 bp, Homo sapiens
  misc_feature: HIJSMM301B9THP.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactgagattaaacgaactgtggctgcaccatctgtcttctat

SEQ ID NO: 586785 - DNA, 509 bp, Homo sapiens; identical to SEQ ID NO: 550053
  misc_feature: HIJSMM301AM4ZW.8.33.C11.1.454.light.4.raw

SEQ ID NO: 586786 - DNA, 504 bp, Homo sapiens; identical to SEQ ID NO: 560645
  misc_feature: HIJSMM301C6OB9.40.67.G01.1.454.light.4.raw

SEQ ID NO: 586787 - DNA, 495 bp, Homo sapiens
  misc_feature: HIJSMM301BZG9F.9.1.A01.1.454.light.4.raw
  modified_base (448)..(448): a, c, t, g, unknown or other
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcaggtgggtctgggacagacttcactctcaccatcagcagactggagcctgaggattttgcagtgtattactgtcagcagtatcataggtcaaacaccttcggccaagggacacgacnggagattaaaggaactgtggctgcaccatctgtcttcatcttccccg

SEQ ID NO: 586788 - DNA, 496 bp, Homo sapiens
  misc_feature: HIJSMM301EKYGE.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctgggaccgaaagtggagatcaaacgaactgtggctgcgaccatctgtctt

SEQ ID NO: 586789 - DNA, 515 bp, Homo sapiens
  misc_feature: HIJSMM301DUU0C.49.10.A10.1.454.light.4.raw
agtcgagagacacgaccggtgctcgatttagcgtcgatctcaggggctgggcctaaggaagcagcactggtggtgcctcagccatggcctggaccgttctcctcctcggcctcctctctcactgcacagactctgtgacctcctatgttctgactcagccgccctcggcgtcagtggccccaggacagacggccacgattccctgtaggggagacgacattggagggaaagctgtgcattggtaccagcagaagccaggccaggcccctgagctggtcctccatggtgatagcgaccggccctcaggaatccctgagagattctccggctccaactctggggagatggccaccctgaccattaccagggccgaagccggggatgaggccgactattactgtcaggtgtgggatagtggtagtggtgtcgtcttcggagctgggaccagggtcaccgtcctaggtcagcccaaggccaaccccactgtcactctgttcccaccctcctctctctcg

SEQ ID NO: 586790 - DNA, 486 bp, Homo sapiens
  misc_feature: HIJSMM301CSWUN.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgctagtttattactgtcagcagtatcataactggccgctcaccttcggccaagggacacgactggagattaaacgaactgtggctgcaccat

SEQ ID NO: 586791 - DNA, 508 bp, Homo sapiens
  misc_feature: HIJSMM301DU1LZ.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtctaggtcagcccaaggctgccccctggtcactctgttccccacctcctgctacgt

SEQ ID NO: 586792 - DNA, 489 bp, Homo sapiens
  misc_feature: HIJSMM301CQDTK.52.41.D08.1.454.light.4.raw
cgcagtacgacacgaccggtgctcgatttagtcacgcgagaaagggaaagggggctggggtctcaggaggcagcactctcgggacgtctccaccatggcctgggctctgctcctcctcagcctcctcactcagggcacaggatcctgggctcagtctgccctggctcagcctcgctcagtgtccgggtctcctggacagtcagtcaccatctcctgcactggcaccaacagtgattttggtggttatgattctgtcttctggtaccaacggcacccaggcaaagtccccaaactcatgattactgatatcaataagaggccctcaggggtccctgatcgcttctctggctccaagtctggcaacacggcctccctgaccatctctgggctccaggctgaggatgaggctgaatatttctgctgctcatatgcaggcgctacacttatgtcttcggaactgggacccaggtcaccgtcctaggtcagccc

SEQ ID NO: 586793 - DNA, 488 bp, Homo sapiens
  misc_feature: HIJSMM301C2HLY.41.16.B05.1.454.light.4.raw
tctatactatcacgaccggtgctcgatttagagctcacgtaagggggggaggaactgctcagttaggacccagacggaaccatggaagccccagcgcagcttctcttcctcctgctactctggctcccagataccactggagacatagtgatgacgcagtctccagccaccctgtctgtgtctccaggggagacagccaccctctcctgcagggccagtcagagtgttagtaacaacttagcatggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtctt

SEQ ID NO: 586794 - DNA, 447 bp, Homo sapiens; identical to SEQ ID NO: 535201
  misc_feature: HIJSMM301AXGXO.18.9.A09.1.454.light.4.raw

SEQ ID NO: 586795 - DNA, 486 bp, Homo sapiens; identical to SEQ ID NO: 535458
  misc_feature: HIJSMM301BNEAR.7.75.G09.1.454.light.4.raw

SEQ ID NO: 586796 - DNA, 509 bp, Homo sapiens
  misc_feature: HIJSMM301EDIVG.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaaactgtggctgcaccatctgtcttcta

SEQ ID NO: 586797 - DNA, 509 bp, Homo sapiens
  misc_feature: HIJSMM301DZS6R.52.46.E02.1.454.light.4.raw
cgcagtacgacacgaccggtgctcgatttagactcatctacagggaaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacgttggtacttataattctgtctcctggtaccaacaataccccggcaaagtccccaaactcatgatctttgaggtcaatgatcggcccgcaggggtttctcatcgcttctccggctccaagtctggcagcacggcctccctgaccatctctgggctccaggctgaggacgaggctgattattactgcagctcatatacaaacagaaacacttgggtgttcggcggcgggaccagactgaccgtcctacgtcagcccaaggctgccccctcggtcta

SEQ ID NO: 586798 - DNA, 522 bp, Homo sapiens
  misc_feature: HIJSMM301AX1D5.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccggttctcaggctccctcgttgggggcaaagctgccctgaccctttcgggtgcgcagcctgaggatgaggctgagtattactgcttgctctcctatagtggtgttcgggtgttcggcggagggaccaagctgaccgtcctaggtcagcccaaggctgccccctcggtcactctgttcccgccctcctcctagtct

SEQ ID NO: 586799 - DNA, 500 bp, Homo sapiens
  misc_feature: HIJSMM301ARZD2.3.27.C05.1.454.light.4.raw
agacgcactccacgaccggtgctcgatttagacgcgatcgaagggtttgggggagctacaacaggcaggcaggggcagcaagatggtgttgcagacccaggtcttcatttctctgttgctctggatctctggtgcctacggggacatcgtgatgacccagtccccagactccctggctgtgtctctgggcgagagggccaccatcaactgcaagtccagccagagtgttttatacagctccgacaataagaactacttagcttggtaccagcagaaaccaggacagcctcctaaactgctcatttactgggcatctacccgggaatccggggcccctgaccgattcaatggcagcgggtctgggcagatttcactctcaccatcagcagcctgcaggctgaagatgtggcagtttattactgtcagcaatattatactcctcttccgacgttcggccaaggaccaaggtggaaatacaaacgaactagtggctgcaccat

SEQ ID NO: 586800 - DNA, 504 bp, Homo sapiens
  misc_feature: HIJSMM301DPKQJ.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgatttattactgcagctcatatgcagttggttcctctttcaagatattcggcggagggaccaggctgaccgtcctgagtcagcccaaggctgcccccc

SEQ ID NO: 586801 - DNA, 495 bp, Homo sapiens
  misc_feature: HIJSMM301C1OIZ.12.23.C01.1.454.light.4.raw
atacgacgtacacgaccggtgctcgatttagtacacgtgattagggattgggggaggaactgctcagttaggacccagacggaaccatggaagccccagcgcagcttctcttcctcctgctactctggctcccagataccactggagaaatagtgatgaagcagtctccagccaccctgtctgtgtctccaggggaaagagccaccctctcctgcagggccagtcagagtgttaatagcgacttagcctggtaccagcagatacctggccaggctcccaggctcctcatctatggtgcatctaccagggccactggtatcccagccaggttcagtggcagtgggtctgggacagagttcactctcaccatcagcagcctgcagtctgaagattttgctagtttattactgtcagcagtataataactggttcctgctcacgtttcggcgggggaccgaaggtggagatcaaacgaactgtggctgcaccatctgt

SEQ ID NO: 586802 - DNA, 441 bp, Homo sapiens; identical to SEQ ID NO: 535074
  misc_feature: HIJSMM301DGCR6.11.3.A03.1.454.light.4.raw

SEQ ID NO: 586803 - DNA, 495 bp, Homo sapiens; identical to SEQ ID NO: 550605
  misc_feature: HIJSMM301C2C07.41.38.D05.1.454.light.4.raw

SEQ ID NO: 586804 - DNA, 496 bp, Homo sapiens
  misc_feature: HIJSMM301DKFE4.3.33.C11.1.454.light.4.raw
agacgcactccacgaccggtgctcgatttagagtgagctcggttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccacctcctcgagtgcgtct

SEQ ID NO: 586805 - DNA, 483 bp, Homo sapiens; identical to SEQ ID NO: 573020
  misc_feature: HIJSMM301DIU7E.5.45.E01.1.454.light.4.raw

SEQ ID NO: 586806 - DNA, 483 bp, Homo sapiens; identical to SEQ ID NO: 535375
  misc_feature: HIJSMM301D1IPK.47.48.E04.1.454.light.4.raw

SEQ ID NO: 586807 - DNA, 488 bp, Homo sapiens; identical to SEQ ID NO: 562072
  misc_feature: HIJSMM301D5Y10.22.86.H09.1.454.light.4.raw

SEQ ID NO: 586808 - DNA, 479 bp, Homo sapiens; identical to SEQ ID NO: 553293
  misc_feature: HIJSMM301A6HQ0.9.76.G10.1.454.light.4.raw

SEQ ID NO: 586809 - DNA, 491 bp, Homo sapiens; identical to SEQ ID NO: 561247
  misc_feature: HIJSMM301D6CUB.4.52.E08.1.454.light.4.raw

SEQ ID NO: 586810 - DNA, 501 bp, Homo sapiens
  misc_feature: HIJSMM301C0IZ5.19.71.G05.1.454.light.4.raw
  modified_base (486)..(486): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgttcaacaatattattatattcgtggacgtcgtccgacggaccgaacggtaggagtagtacanagaacaagtggcgtg

SEQ ID NO: 586811 - DNA, 480 bp, Homo sapiens; identical to SEQ ID NO: 535442
  misc_feature: HIJSMM301AGCTY.41.17.B06.1.454.light.4.raw

SEQ ID NO: 586812 - DNA, 492 bp, Homo sapiens
  misc_feature: HIJSMM301BG8W2.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaacgggaccgaacggtggaaagtacaaacgaacctagtggctgcaccta

SEQ ID NO: 586813 - DNA, 486 bp, Homo sapiens; identical to SEQ ID NO: 535043
  misc_feature: HIJSMM301EI7E4.46.35.D02.1.454.light.4.raw

SEQ ID NO: 586814 - DNA, 489 bp, Homo sapiens; identical to SEQ ID NO: 535139
  misc_feature: HIJSMM301B6SXJ.14.55.E11.1.454.light.4.raw

SEQ ID NO: 586815 - DNA, 497 bp, Homo sapiens; identical to SEQ ID NO: 535286
  misc_feature: HIJSMM301EHTOS.18.59.F04.1.454.light.4.raw

SEQ ID NO: 586816 - DNA, 485 bp, Homo sapiens
  misc_feature: HIJSMM301EI9VV.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccatacacttttggccaggggaccaaactaggacatcaaacgaactagtggctgcaccat

SEQ ID NO: 586817 - DNA, 504 bp, Homo sapiens
  misc_feature: HIJSMM301DDNVN.10.82.H05.1.454.light.4.raw
catagtagtgcacgaccggtgctcgatttagtcgagctctctcgcgggggcttcagctgtgagcgcagaaggcaggactcgggacaatcttcatcatgacctgctcccctctcctcctcacccttctcattcactgcacagggtcctgggcccagtctgtattgacgcagccgccctcagtgtctgcggccccaggacagaaggtcaccatctcctgctctggaggcagttccaacattgggaattcttatgtttcctggtaccagcacatcccaggaggtgcccccaaatcctcatatatgaagatgataagcgaccgtcagggattcctgaccgattctctggctccaagtctggcacgtcggccacctgggcatcgccggactccagactggggacgaggccgatttttactgcggaacatgggataccagcctgcatggtgtggttttcggcggagggaccaagctgaccgtcctaagtcagcccaaggctgtccccccg

SEQ ID NO: 586818 - DNA, 500 bp, Homo sapiens
  misc_feature: HIJSMM301DCONB.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagtattttgcagtgtattactgtcagcagtatggtagctcacctcggacgttcggtccgaacgggaccgaacggaggaagtacaaacgaactagtggctgcaccactctgtt

SEQ ID NO: 586819 - DNA, 454 bp, Homo sapiens; identical to SEQ ID NO: 534964
  misc_feature: HIJSMM301AIEOS.19.86.H09.1.454.light.4.raw

SEQ ID NO: 586820 - DNA, 490 bp, Homo sapiens
  misc_feature: HIJSMM301BBBXE.47.78.H01.1.454.light.4.raw
agctcacgtacacgaccggtgctcgatttagtgtgagtagtttgggtttgggaacctatgaacattctgtaggggccactgtcttctccacggtgctcccttcatgcgtgactcagccaccctcagcgtctgggacccccgggcagagggtcgtcatctcttgctctggaagcagctccaacatcggaaggaatgatgtgtactggttgcagcaactccccggaacggcccccaaactcctcatctatacgaataatcagcggtcctcaggggtccctgaccgattctctggctccaagtctgacacctcagcctccctggccatcagtgggctccggtccgaggatgaggctgattattattgtgcaacatgggatagtagcctgagtagtgtggttttcggtcggagggaccgaaactagaccgtcctaggtcagcccaacggctgccccctccggtcactctgttcccgccctcctctacgtgagct

SEQ ID NO: 586821 - DNA, 515 bp, Homo sapiens
  misc_feature: HIJSMM301AY57R.14.19.B08.1.454.light.4.raw
  modified_base (506)..(506): a, c, t, g, unknown or other
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtctaagtcagcccaaggctcgccccctcggtcactctgttcccnccctcctcg

SEQ ID NO: 586822 - DNA, 486 bp, Homo sapiens; identical to SEQ ID NO: 535458
  misc_feature: HIJSMM301AOCJT.7.75.G09.1.454.light.4.raw

SEQ ID NO: 586823 - DNA, 478 bp, Homo sapiens; identical to SEQ ID NO: 535129
  misc_feature: HIJSMM301BSPCE.11.11.A11.1.454.light.4.raw

SEQ ID NO: 586824 - DNA, 494 bp, Homo sapiens
  misc_feature: HIJSMM301EPGM3.43.33.C11.1.454.light.4.raw
tgtgagtagtcacgaccggtgctcgatttagagtgagctcgttgggtttgggggaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagaccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctcctcccccctacaatttcggtcaggggaccaagttgaacatcaatccgaactgtggctgcaccatctgtctt

SEQ ID NO: 586825 - DNA, 495 bp, Homo sapiens; identical to SEQ ID NO: 535821
  misc_feature: HIJSMM301ALDJS.3.31.C09.1.454.light.4.raw

SEQ ID NO: 586826 - DNA, 513 bp, Homo sapiens; identical to SEQ ID NO: 547639
  misc_feature: HIJSMM301CL7GO.43.59.F04.1.454.light.4.raw

SEQ ID NO: 586827 - DNA, 497 bp, Homo sapiens; identical to SEQ ID NO: 564836
  misc_feature: HIJSMM301AIQ0Q.16.78.H01.1.454.light.4.raw

SEQ ID NO: 586828 - DNA, 495 bp, Homo sapiens; identical to SEQ ID NO: 538942
  misc_feature: HIJSMM301CC51N.43.61.F06.1.454.light.4.raw

SEQ ID NO: 586829 - DNA, 511 bp, Homo sapiens
  misc_feature: HIJSMM301CWSP4.40.47.E03.1.454.light.4.raw
tctagcgactcacgaccggtgctcgatttagactcgcgcacagagagaaggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcactctcg

SEQ ID NO: 586830 - DNA, 513 bp, Homo sapiens
  misc_feature: HIJSMM301AE730.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctggtcactctgttcccgccctcct

SEQ ID NO: 586831 - DNA, 512 bp, Homo sapiens
  misc_feature: HIJSMM301DAONX.5.27.C05.1.454.light.4.raw
atcagacacgcacgaccggtgctcgatttagacgcgatcgaagggtttgggagggtttgggaacctatgaacattctgtaggggccactttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggcccaaccccactgtcactctgttcccaccctcctccgtgtctgat

SEQ ID NO: 586832 - DNA, 486 bp, Homo sapiens; identical to SEQ ID NO: 535043
  misc_feature: HIJSMM301BYEGM.46.35.D02.1.454.light.4.raw

SEQ ID NO: 586833 - DNA, 501 bp, Homo sapiens
  misc_feature: HIJSMM301A6MQV.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattatattgctgctcatatgcaggtagttacacttatgtcttcggaattgggacgacggtcaccgtcctaggtcagcccaaggccaacccctac

SEQ ID NO: 586834 - DNA, 498 bp, Homo sapiens; identical to SEQ ID NO: 578989
  misc_feature: HIJSMM301BY4QF.43.34.D01.1.454.light.4.raw

SEQ ID NO: 586835 - DNA, 492 bp, Homo sapiens; identical to SEQ ID NO: 541650
  misc_feature: HIJSMM301ESTK7.5.57.F02.1.454.light.4.raw

SEQ ID NO: 586836 - DNA, 503 bp, Homo sapiens; identical to SEQ ID NO: 537189
  misc_feature: HIJSMM301BPH57.19.85.H08.1.454.light.4.raw

SEQ ID NO: 586837 - DNA, 473 bp, Homo sapiens
  misc_feature: HIJSMM301CYYRN.52.87.H10.1.454.light.4.raw
cgcagtacgacacgaccggtgctcgatttagcagtactgcgttgggtttggggctgggcctcaggaagcagcatcggaggtgcctcagccatggcatggatccctctcttcctcggcgtccttgcttactgcacaggatccgtggcctcctatgagctgactcagccacactcagtgtccgtgtccccaggacagacagccagcatcacctgctctggagatgaattggggaataaatttgcttgctggtatcaccagaagccaggccagtcccctgtcctggtcatctatcaagatgtcaagcggccctcagggatccctgagcgattctctggctccaactctgggaacacagccactctgaccatcagcgggacccaggctatggatgaggctgactattactgtcaggcgtgggacagcaacactgtggtattcggcggagggaccaagctgaccgtcaggtcagccaa

SEQ ID NO: 586838 - DNA, 492 bp, Homo sapiens; identical to SEQ ID NO: 535126
  misc_feature: HIJSMM301ANI25.18.11.A11.1.454.light.4.raw

SEQ ID NO: 586839 - DNA, 508 bp, Homo sapiens
  misc_feature: HIJSMM301BDDX8.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggccctcagggatccctgagcgcttctctggctccaattctgggaacacggccaccctgaccatcagcgcggtcgaagccggagatgaggccgactattactgtcaggtgtgggacagtaatagtgatcccgagcaggttttcggcggtgggaccaagctgaccgtctaagtcagcccaaggctgccccctcggtcactctgtt

SEQ ID NO: 586840 - DNA, 494 bp, Homo sapiens
  misc_feature: HIJSMM301AI8WA.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggccaacggaccgacggtaggaagtacaaacgaactacgtaggtcgtgcaccactctgtcttt

SEQ ID NO: 586841 - DNA, 471 bp, Homo sapiens; identical to SEQ ID NO: 537461
  misc_feature: HIJSMM301AGTQL.7.81.H04.1.454.light.4.raw

SEQ ID NO: 586842 - DNA, 476 bp, Homo sapiens; identical to SEQ ID NO: 547708
  misc_feature: HIJSMM301CS1TA.12.1.A01.1.454.light.4.raw

SEQ ID NO: 586843 - DNA, 490 bp, Homo sapiens; identical to SEQ ID NO: 537951
  misc_feature: HIJSMM301BOCPB.19.57.F02.1.454.light.4.raw

SEQ ID NO: 586844 - DNA, 485 bp, Homo sapiens; identical to SEQ ID NO: 535501
  misc_feature: HIJSMM301CKUEW.3.10.A10.1.454.light.4.raw

SEQ ID NO: 586845 - DNA, 506 bp, Homo sapiens
  misc_feature: HIJSMM301DRPVZ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtccaagggaccaaggtggaaagtacaaacgaactagtggctgcaccatctgtcttcatcttccccg

SEQ ID NO: 586846 - DNA, 523 bp, Homo sapiens
  misc_feature: HIJSMM301BQWV3.53.77.G11.1.454.light.4.raw
cgcgtatacacacgaccggtgctcgatttagctagtcactcaagggaaagggggggcctaaggaagcagcactggtggtgcctcagccatggcctggaccgttctcctcctcggcctcctctctcactgcacaggctctgtgacctcctttgtgctgactcagtcaccctcggtgtcggtggccccaggacagacggccaggattacctgtgggggaaacaacattggaaggaaaagtgtgcactggtaccagcagatgccaggccaggcccctgtgttggtcgtctatgatgatagcgaccggccctcaggggtccctgagcgattctctggctccaactctgggaacacggccaccctgaccataagcagggtcgaagccggggatgaggccgactattactgtcaggtgtgggatactagtagtgatcatccttgggtgttcggcggtgggaccaggctgaccgtcctaggtcagcccaaggctgccccctcggtcactctgttcccgccctcctctcgt

SEQ ID NO: 586847 - DNA, 498 bp, Homo sapiens; identical to SEQ ID NO: 535295
  misc_feature: HIJSMM301AJQ25.15.25.C03.1.454.light.4.raw

SEQ ID NO: 586848 - DNA, 512 bp, Homo sapiens
  misc_feature: HIJSMM301CHNW1.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcgccaggacaagtggcaatcaacgaactgtggctgcaccatctgtcttcatcttccccg

SEQ ID NO: 586849 - DNA, 486 bp, Homo sapiens; identical to SEQ ID NO: 535043
  misc_feature: HIJSMM301AVI6C.46.35.D02.1.454.light.4.raw

SEQ ID NO: 586850 - DNA, 505 bp, Homo sapiens
  misc_feature: HIJSMM301ED0A8.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgattattcggcggagggaccaaacgtgaccgtcctaggtcagcccaaggctcgccccctc

SEQ ID NO: 586851 - DNA, 489 bp, Homo sapiens; identical to SEQ ID NO: 535139
  misc_feature: HIJSMM301EPUYC.14.55.E11.1.454.light.4.raw

SEQ ID NO: 586852 - DNA, 482 bp, Homo sapiens; identical to SEQ ID NO: 537007
  misc_feature: HIJSMM301BJZ04.41.34.D01.1.454.light.4.raw

SEQ ID NO: 586853 - DNA, 494 bp, Homo sapiens
  misc_feature: HIJSMM301BSBAG.22.57.F02.1.454.light.4.raw
acatacgcgtcacgaccggtgctcgatttagctcgatatagttgggtttggggagtcagacccagtcaggacacagcatggacatgagggtccccgctcagctcctggggctcctgctgctctggctcccaggtgccaagtgtgacatccagatgacccagtctccttccaccctggctgcatctgtaggagacagagtcaccatcacttgtcgggccagtcagaatattaatagttggttggcctggtatcagcagaaaccagggaaagcccctatactcctgatccacaaggcgtctactttagaaagtggggtcccatcaaggttcagcggcactggatctgggacagaattcactctcaccatcaacagcctgcagcctgatgatttggcaacttactactgccaaccgtatagtacttattcggtcaccttcggccaagggacacgactggagattaaacgaactagtggctgcaccatctgtcttcat

SEQ ID NO: 586854 - DNA, 362 bp, Homo sapiens
  misc_feature: HIJSMM301BMJ60.3.57.F02.1.454.light.4.raw
agacgcactccacgaccggtgctcgatttagctcgatatagttgggtttgggggtgtggtggtctccactcccgccttgacggggctgctatctgccttccaggcccttatcctggtcatcaattatgacagcgaccggccctcagggatccctgagcgattctctggctccaactctgggaacacggccaccctgaccatcaccaggggtcgaggccgaggatgaggccgactattactgtcaggtgtgggatagccgttctgatcattgggtcttcggcggcgggaccaagctgaccgtcctatgtcaacccaaggctggcccctcggtcactctgttcccgccctcctcgagtgcgtct

SEQ ID NO: 586855 - DNA, 488 bp, Homo sapiens
  misc_feature: HIJSMM301CQR8V.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggtccagggaccgaagctggagatcaaacgaaactgtggctgcaccat

SEQ ID NO: 586856 - DNA, 516 bp, Homo sapiens
  misc_feature: HIJSMM301DPW7K.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttggtgttcggcggagggaccatgctgaccgtcctgagtcagcccaaggctgccccctcggtcactctgttcccaccct

SEQ ID NO: 586857 - DNA, 482 bp, Homo sapiens
  misc_feature: HIJSMM301AITG4.10.1.A01.1.454.light.4.raw
catagtagtgcacgaccggtgctcgatttagacgtctcatcaggggctccaaacagagcttcagcaagcatagtgggaatctgcaccatgccctgggctctgctcctcctgaccctcctcactcactctgcagtgtcagtggtccaggcagggctgactcagccaccctcggtatccaaggacttgagacagaccgccacactcacctgcactgggaacaacaacaatgttggccacgacggagtcgtttggctgcagcagcaccagggccaccctcccaagctcctctccgacaggaataacatccggccctcagggatctcagagagattctctgcatccaggtcaggaagcacagcctccctgaccattactggactccaggctgacgacgaagctgattattactgctcagcatgggacaccggcctcagtgcgtgggttttcggcggagggaccaagctgaccgtcctaggtctacg

SEQ ID NO: 586858 - DNA, 514 bp, Homo sapiens
  misc_feature: HIJSMM301ECCDY.40.12.B01.1.454.light.4.raw
tctagcgactcacgaccggtgctcgatttagtagtgtagattccgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaactacacccaggcaaagcccccaaactcatgatttctgacgtcagtaagcggccctcaggggtccctgatcgcttctctggctccaagtctggcaacacggcctccctgaccgtctctgggctccaggctgaagatgaggctgattattactgctactcgtatgcaggcggcaacaattgggtcttcggcggagggaccaagctgaccgtcctaggtcagcccaaggctgccccctggtccactctgttccca

SEQ ID NO: 586859 - DNA, 485 bp, Homo sapiens; identical to SEQ ID NO: 535606
  misc_feature: HIJSMM301CUMRF.47.46.E02.1.454.light.4.raw

SEQ ID NO: 586860 - DNA, 505 bp, Homo sapiens
  misc_feature: HIJSMM301ADTZL.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtccaggtcagcccaaggccaaccccactgtca

SEQ ID NO: 586861 - DNA, 505 bp, Homo sapiens; identical to SEQ ID NO: 535503
  misc_feature: HIJSMM301AI6MF.8.28.C06.1.454.light.4.raw

SEQ ID NO: 586862 - DNA, 495 bp, Homo sapiens; identical to SEQ ID NO: 547141
  misc_feature: HIJSMM301C2ICM.9.1.A01.1.454.light.4.raw

SEQ ID NO: 586863 - DNA, 491 bp, Homo sapiens; identical to SEQ ID NO: 535294
  misc_feature: HIJSMM301D1Y8I.16.68.G02.1.454.light.4.raw

SEQ ID NO: 586864 - DNA, 507 bp, Homo sapiens; identical to SEQ ID NO: 585758
  misc_feature: HIJSMM301BF7CC.18.37.D04.1.454.light.4.raw

SEQ ID NO: 586865 - DNA, 509 bp, Homo sapiens
  misc_feature: HIJSMM301BIXWZ.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaattgagatcaaacgaactagtggctgcaccatctgtcttcatcttcccg

SEQ ID NO: 586866 - DNA, 489 bp, Homo sapiens
  misc_feature: HIJSMM301B7GOM.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgtccacttttggccaggggaccaagctggagatcaggcgaacg

SEQ ID NO: 586867 - DNA, 494 bp, Homo sapiens
  misc_feature: HIJSMM301AXDYR.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggaggaccgaaggtggagatcaaacgaactgtggctgcaccatctgtcttcta

SEQ ID NO: 586868 - DNA, 496 bp, Homo sapiens; identical to SEQ ID NO: 537925
  misc_feature: HIJSMM301A7SHD.22.14.B03.1.454.light.4.raw

SEQ ID NO: 586869 - DNA, 493 bp, Homo sapiens
  misc_feature: HIJSMM301BX3E4.40.11.A11.1.454.light.4.raw
tctagcgactcacgaccggtgctcgatttagctacgactgcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtcttcatccttcccgccat

SEQ ID NO: 586870 - DNA, 504 bp, Homo sapiens
  misc_feature: HIJSMM301AJYRA.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtgggcccaagtggaggatgaagctgactactactgttactcaatagagaacagtgataatttctgggtgttcggcggagggaccaaactgaccgtcctaggtcagcccaaggctgccccctcggtccactctgtt

SEQ ID NO: 586871 - DNA, 494 bp, Homo sapiens; identical to SEQ ID NO: 536974
  misc_feature: HIJSMM301DPFP7.16.86.H09.1.454.light.4.raw

SEQ ID NO: 586872 - DNA, 483 bp, Homo sapiens
  misc_feature: HIJSMM301BJV16.4.19.B08.1.454.light.4.raw
agcactgtagcacgaccggtgctcgatttagtgagtcagtaaggggggagtcagactcagtcaggacacagcatggacatgagggtccccgctcagctcctggggctcctgctgctctggctcccaggagccgattgtgacatccagttgacccagtctccctccaccctgtctgcatctataggagacagagtcaccatcacttgtcgggccagtcagaatatcaataggtggttggcctggtatctgcagagaccagggagagccccaaaactccttatctatgatgcctctactttgcacactggggtcccaccaacgttcagcggcagtggatccgggacagaattcactctcaccatcagcagcctgcagcctgatgatcttggaacttattactgccaacagtataaatagttattggacgttcggccaggggaccaaggtggaattcaaacgaactgtggctgcaccatctgtctt

SEQ ID NO: 586873 - DNA, 507 bp, Homo sapiens
  misc_feature: HIJSMM301DOWI7.17.87.H10.1.454.light.4.raw
cgtagactagcacgaccggtgctcgatttagcagtactgcgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggtcagtcgatcaccatctcctgcactggaagcggcagtgatgttgggggttataaccttgtctcctggtaccaacaccacccagaccaaagcccccaaactcatcctttatgagggcactaagcggccctcaggggtttctaatcgcttcgctggctccacgtctggcagcacggcctccctgacaatctctgggctccaggctgaggacgaggctgattattactgctgctcatattcaagtcgtgtcactatgatttttggcggaggcaccaaggtgaccgtcctaggtcagcccaaggctgccccctcggtca

SEQ ID NO: 586874 - DNA, 504 bp, Homo sapiens; identical to SEQ ID NO: 542411
  misc_feature: HIJSMM301BGK1I.9.53.E09.1.454.light.4.raw

SEQ ID NO: 586875 - DNA, 516 bp, Homo sapiens; identical to SEQ ID NO: 551269
  misc_feature: HIJSMM301CB0JM.47.53.E09.1.454.light.4.raw

SEQ ID NO: 586876 - DNA, 499 bp, Homo sapiens; identical to SEQ ID NO: 537800
  misc_feature: HIJSMM301BJBJW.22.38.D05.1.454.light.4.raw

SEQ ID NO: 586877 - DNA, 480 bp, Homo sapiens; identical to SEQ ID NO: 535975
  misc_feature: HIJSMM301ENCVD.51.60.F05.1.454.light.4.raw

SEQ ID NO: 586878 - DNA, 444 bp, Homo sapiens; identical to SEQ ID NO: 535856
  misc_feature: HIJSMM301CWHVQ.9.9.A09.1.454.light.4.raw

SEQ ID NO: 586879 - DNA, 515 bp, Homo sapiens
  misc_feature: HIJSMM301CCY0B.48.25.C03.1.454.light.4.raw
agtatacatacacgaccggtgctcgatttagtagtgtagatttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttttctggatcgaactcagggacattggccaccttgactatcactggggcccaggtggaggatgaaggtgactacttctgtttctcaacagacaccagtgacaatcatgcgattttcggcggagggaccaagctgaccgtcctggtcagcccaaggctgccccctcggtcactctcgttcccaccct

SEQ ID NO: 586880 - DNA, 492 bp, Homo sapiens
  misc_feature: HIJSMM301EWIQW.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggttcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaaggacacgactggagattaaaggaactgtggctgcaccatctgtcttcatcttcccg

SEQ ID NO: 586881 - DNA, 487 bp, Homo sapiens; identical to SEQ ID NO: 549649
  misc_feature: HIJSMM301A85GX.19.71.G05.1.454.light.4.raw

SEQ ID NO: 586882 - DNA, 474 bp, Homo sapiens; identical to SEQ ID NO: 586533
  misc_feature: HIJSMM301CODH7.7.81.H04.1.454.light.4.raw

SEQ ID NO: 586883 - DNA, 507 bp, Homo sapiens; identical to SEQ ID NO: 538063
  misc_feature: HIJSMM301A8PRD.47.85.H08.1.454.light.4.raw

SEQ ID NO: 586884 - DNA, 507 bp, Homo sapiens; identical to SEQ ID NO: 541461
  misc_feature: HIJSMM301C4TDU.11.57.F02.1.454.light.4.raw

SEQ ID NO: 586885 - DNA, 511 bp, Homo sapiens
  misc_feature: HIJSMM301DUO75.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactagtggctgcaccatctgtcttctatcttcccg

SEQ ID NO: 586886 - DNA, 485 bp, Homo sapiens; identical to SEQ ID NO: 535822
  misc_feature: HIJSMM301CXTQ6.14.53.E09.1.454.light.4.raw

SEQ ID NO: 586887 - DNA, 517 bp, Homo sapiens
  misc_feature: HIJSMM301ANZ0J.49.17.B06.1.454.light.4.raw
agtcgagagacacgaccggtgctcgatttagtcgatagtgaagggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcggtgacgttggtgtttataactatgtctcctggtaccaacaccacccaggcaaagcccccaaactcatgatttatgatgtcagtgatcggccctcaggggtttcgaatcgcttctctggctccaagtccggcaacacggcctccctgaccatctctggcctccaggccgaggacgaggctgattattactgcagctcatatacaaccagcaacaattgggtgttcggcggaggggaccaaaactgaccgtcctagggtcagcccaaggctgccccctcggtcactctcgttccca

SEQ ID NO: 586888 - DNA, 476 bp, Homo sapiens; identical to SEQ ID NO: 538611
  misc_feature: HIJSMM301C2SH9.7.81.H04.1.454.light.4.raw

SEQ ID NO: 586889 - DNA, 521 bp, Homo sapiens; identical to SEQ ID NO: 539470
  misc_feature: HIJSMM301B1SXM.27.23.C01.1.454.light.4.raw

SEQ ID NO: 586890 - DNA, 493 bp, Homo sapiens
  misc_feature: HIJSMM301AKWTG.51.28.C06.1.454.light.4.raw
cgatcgtatacacgaccggtgctcgatttagagctcacgtattgggtttgggggggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgactttactgtcaggcgtgggacagcgacactgccgtgttcggcgggggaccgaagctgaccgtcctcggtcagcccaaggctgccccctccggtcact

SEQ ID NO: 586891 - DNA, 513 bp, Homo sapiens; identical to SEQ ID NO: 564131
  misc_feature: HIJSMM301EYB5Y.14.78.H01.1.454.light.4.raw

SEQ ID NO: 586892 - DNA, 484 bp, Homo sapiens; identical to SEQ ID NO: 541607
  misc_feature: HIJSMM301DK98U.17.26.C04.1.454.light.4.raw

SEQ ID NO: 586893 - DNA, 486 bp, Homo sapiens
  misc_feature: HIJSMM301DWMD6.41.54.E10.1.454.light.4.raw
tctatactatcacgaccggtgctcgatttagatcgtagcagaacacacaaagggggatcaggactcctcagttcaccttctcacaatgaggctccctgctcagctcctggggctgctaatgctctgggtcccaggatgcagtggggatgctattctgactcagtcgccgctctccctgcccgtctcccttggacagccggcctccatttcctgcacgtctagtcaaagtctcctacatgatgatggaaacacctacctgacttggtttcaccacaggccaggccaatctccaaggcgcctaatttatcaggtttcgaagcgggactctggggtcccaggcagattcagcggcagtgggtcaggctctgctttcacgctgagaatcaacagggtggaggctgaggatgttggtggtttattactgcatgcaaggttcatattggccgtgcagttttggccaggggaccaagttggagatcaaacgaa

SEQ ID NO: 586894 - DNA, 488 bp, Homo sapiens; identical to SEQ ID NO: 543022
  misc_feature: HIJSMM301AUSHB.9.59.F04.1.454.light.4.raw

SEQ ID NO: 586895 - DNA, 502 bp, Homo sapiens; identical to SEQ ID NO: 537363
  misc_feature: HIJSMM301BG9GO.18.23.C01.1.454.light.4.raw

SEQ ID NO: 586896 - DNA, 495 bp, Homo sapiens
  misc_feature: HIJSMM301A1BAJ.5.48.E04.1.454.light.4.raw
atcagacacgcacgaccggtgctcgatttagagagcgtcacagagagaaggggctggagaagagctgctcagttaggacccagagggaaccatggaaaccccagcgcagcttctcttcctcctgctactctggctcccagattctgccggagaagttgtcttgacgcagtctccaggcaccctgtctttgtctccaggtgaaagcgccaccctctcctgccgggccagtgagagtcttagcggcgactacttagcctggtatcagcaaaaacctggccagtctcccaggctcctcatctctggtgtttccttcagggccactggcgtcccaggcagattcaggggcagtgggtctgggacagacttcactctcaccatcagcagactggagcctgaagactttgcgctgtatttctgtcagcagtatgttttcgctacctttcactttcggcggagggaccaaggtggagagcagacgaactgtggctgcaccta

SEQ ID NO: 586897 - DNA, 487 bp, Homo sapiens; identical to SEQ ID NO: 538190
  misc_feature: HIJSMM301EBAG1.47.70.G04.1.454.light.4.raw

SEQ ID NO: 586898 - DNA, 504 bp, Homo sapiens
  misc_feature: HIJSMM301DDVNM.49.82.H05.1.454.light.4.raw
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctgggggacgaggctgattattattgctgttcatatgccggtgatagtggccgaagggtgttcggcggagggaccaaggtgaccgtcctaggtcagcccaaggctgccccctcggt

SEQ ID NO: 586899 - DNA, 496 bp, Homo sapiens
  misc_feature: HIJSMM301EMA91.19.71.G05.1.454.light.4.raw
tactctcgtgcacgaccggtgctcgatttagtgtcgtcgcaagagagagggggtcaggctggaactgaggagcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaaggtggagtatcagacggaaa

SEQ ID NO: 586900 - DNA, 510 bp, Homo sapiens; identical to SEQ ID NO: 553863
  misc_feature: HIJSMM301AHR7G.16.46.E02.1.454.light.4.raw

SEQ ID NO: 586901 - DNA, 516 bp, Homo sapiens; identical to SEQ ID NO: 568159
  misc_feature: HIJSMM301BSBW6.49.11.A11.1.454.light.4.raw

SEQ ID NO: 586902 - DNA, 484 bp, Homo sapiens; identical to SEQ ID NO: 559395
  misc_feature: HIJSMM301BVXUF.3.10.A10.1.454.light.4.raw

SEQ ID NO: 586903 - DNA, 472 bp, Homo sapiens; identical to SEQ ID NO: 535898
  misc_feature: HIJSMM301DWZKS.15.8.A08.1.454.light.4.raw

SEQ ID NO: 586904 - DNA, 489 bp, Homo sapiens; identical to SEQ ID NO: 535139
  misc_feature: HIJSMM301DSO12.14.55.E11.1.454.light.4.raw

SEQ ID NO: 586905 - DNA, 486 bp, Homo sapiens; identical to SEQ ID NO: 535385
  misc_feature: HIJSMM301DAHUH.19.71.G05.1.454.light.4.raw

SEQ ID NO: 586906 - DNA, 476 bp, Homo sapiens; identical to SEQ ID NO: 547708
  misc_feature: HIJSMM301AOZ9I.12.1.A01.1.454.light.4.raw

SEQ ID NO: 586907 - DNA, 496 bp, Homo sapiens; identical to SEQ ID NO: 548004
  misc_feature: HIJSMM301AO1V1.3.35.D02.1.454.light.4.raw

SEQ ID NO: 586908 - DNA, 504 bp, Homo sapiens; identical to SEQ ID NO: 546872
  misc_feature: HIJSMM301EL0Q4.9.53.E09.1.454.light.4.raw

SEQ ID NO: 586909 - DNA, 503 bp, Homo sapiens
  misc_feature: HIJSMM301B7DT2.21.22.B11.1.454.light.4.raw
  modified_base (430)..(430): a, c, t, g, unknown or other
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcaggtgggctccggtccgaggatgaggctgactattactgtgcatcacgggacncaacatgggatgacaatctgagcggttgggtgttcggcggagggaccaaactgaccgtctaggtcagccccaa

SEQ ID NO: 586910 - DNA, 443 bp, Homo sapiens
  misc_feature: HIJSMM301AK0JV.5.9.A09.1.454.light.4.raw
atcagacacgcacgaccggtgctcgatttagcgagacgcgcagggtcctgggcccagtctgtggtgacgcagccgccctccgtttctggggccccagggcagacggtcaccatctcctgcactggaagcagctccgacatcgggtcaggttatgatgtacattggtaccagcaacttccaggaacagcccccaaactcctcatctacgacaacaccaatcggccctcaggggtccctgaccgattctctggctccaggtctggcaccgcagcctccctggccatcactgggctccgggctgaggatgaggctgattattactgccaggcccttgacaacagtttgggtgtttgggtgttcggcggagggaccaagctgaccgtcctaagtcagcccaaggctgccccctcggtcactctgttcccgcctcctccgtgtctgat

SEQ ID NO: 586911 - DNA, 521 bp, Homo sapiens; identical to SEQ ID NO: 538715
  misc_feature: HIJSMM301CWENO.27.23.C01.1.454.light.4.raw

SEQ ID NO: 586912 - DNA, 521 bp, Homo sapiens
  misc_feature: HIJSMM301BLZ39.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctcgccccctccggtcactctgttcccta

SEQ ID NO: 586913 - DNA, 490 bp, Homo sapiens
  misc_feature: HIJSMM301CR64J.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaattttattactgtcagcaatataatacctggcctccgctcactttcggcggagggaccaaggttgagatcaaacgaactgtggctgcaccta

SEQ ID NO: 586914 - DNA, 484 bp, Homo sapiens; identical to SEQ ID NO: 536162
  misc_feature: HIJSMM301BRQZM.13.59.F04.1.454.light.4.raw

SEQ ID NO: 586915 - DNA, 489 bp, Homo sapiens; identical to SEQ ID NO: 535139
  misc_feature: HIJSMM301DA27D.14.55.E11.1.454.light.4.raw

SEQ ID NO: 586916 - DNA, 487 bp, Homo sapiens; identical to SEQ ID NO: 558047
  misc_feature: HIJSMM301C3Z9T.4.26.C04.1.454.light.4.raw

SEQ ID NO: 586917 - DNA, 468 bp, Homo sapiens
  misc_feature: HIJSMM301EKBCF.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggcggggggaccaaggtggagatcaagcgaa

SEQ ID NO: 586918 - DNA, 503 bp, Homo sapiens
  misc_feature: HIJSMM301CE6PO.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtgggtcccatcaaggttcagtggcagtggatttgggacagttttcactctcacaatcagcagtctcgaacctgaagattttgcaacttactactgtcaacagacttacaatataccgaggacgttcggtcaagggaccaaggtggagatcaaacgaactgtggctgcaccatctgtcttcatctcccgccat

SEQ ID NO: 586919 - DNA, 510 bp, Homo sapiens
  misc_feature: HIJSMM301ATKV7.47.85.H08.1.454.light.4.raw
agctcacgtacacgaccggtgctcgatttagtatcactcagtcggcggggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactctgtt

SEQ ID NO: 586920 - DNA, 507 bp, Homo sapiens; identical to SEQ ID NO: 577580
  misc_feature: HIJSMM301B3QL4.15.86.H09.1.454.light.4.raw

SEQ ID NO: 586921 - DNA, 497 bp, Homo sapiens
  misc_feature: HIJSMM301A3JGZ.51.39.D06.1.454.light.4.raw
cgatcgtatacacgaccggtgctcgatttagtgacatctcgcagttctttggggggggagcctagctgtgctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcagggacactggtcacattgaccatcagtggagtccaggcagaagacgaggctgactatttctgtcaatcttcagacgtcagtggtacttatgtcttcggaactgggaccaaggtcaccgtcctaggtcagaccccg

SEQ ID NO: 586922 - DNA, 510 bp, Homo sapiens
  misc_feature: HIJSMM301DHH32.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaaggctgaccgtcctaagtcagcccaaggctgccccctcggtccactctgttcccaccctccc

SEQ ID NO: 586923 - DNA, 497 bp, Homo sapiens; identical to SEQ ID NO: 586437
  misc_feature: HIJSMM301DKNOG.22.14.B03.1.454.light.4.raw

SEQ ID NO: 586924 - DNA, 490 bp, Homo sapiens; identical to SEQ ID NO: 535936
  misc_feature: HIJSMM301BMWU4.16.68.G02.1.454.light.4.raw

SEQ ID NO: 586925 - DNA, 465 bp, Homo sapiens; identical to SEQ ID NO: 549885
  misc_feature: HIJSMM301BRPMV.11.70.G04.1.454.light.4.raw

SEQ ID NO: 586926 - DNA, 516 bp, Homo sapiens; identical to SEQ ID NO: 541685
  misc_feature: HIJSMM301A97BJ.13.55.E11.1.454.light.4.raw

SEQ ID NO: 586927 - DNA, 492 bp, Homo sapiens; identical to SEQ ID NO: 539732
  misc_feature: HIJSMM301A0B63.4.9.A09.1.454.light.4.raw

SEQ ID NO: 586928 - DNA, 399 bp, Homo sapiens
  misc_feature: HIJSMM301CCVKK.8.53.E09.1.454.light.4.raw
ctcgcgtgtccacgaccggtgctcgatttagagagagtgtgttgggtttgggggtgtggtggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgcctcctcgacacgcgag

SEQ ID NO: 586929 - DNA, 502 bp, Homo sapiens
  misc_feature: HIJSMM301EA06B.48.78.H01.1.454.light.4.raw
agtatacatacacgaccggtgctcgatttagtgtgagtagtttgggtttggggggggtcacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgatttattattgctgctcatatgcaggtggtactacttgggtgttcggcagagggaccaagctgaccgtcctaggtcagcccaaggctgccccctc

SEQ ID NO: 586930 - DNA, 507 bp, Homo sapiens
  misc_feature: HIJSMM301CJ2UV.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttccaccctcaccatcaatagcctggaagctgaagatgctgcaacttattactgtcatcagagttactactttacctcaagtgatccaccttcggccaagggacacgactggagaattaaacg

SEQ ID NO: 586931 - DNA, 487 bp, Homo sapiens
  misc_feature: HIJSMM301AZHQN.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgataactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccaggggaccaagctggagatacaaacgaactgtggctgcaccat

SEQ ID NO: 586932 - DNA, 472 bp, Homo sapiens
  misc_feature: HIJSMM301AFEZF.53.83.H06.1.454.light.4.raw
cgcgtatacacacgaccggtgctcgatttagatcacgtgcgtcgcggggctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctccaacatcggggcacgttatgatgtacactggtaccagcaccttccaggagcagcccccaacctcctcctctctggtaacaccaatcggccctcaggggtccctgaccgattctctggctcgaagtctggcacctcagcctccctggccatcactggcctccaggctgaggatgaggctgattattactgccagtcctatgacagcagcctgaatgcttatgtcttcggaactgggacc

SEQ ID NO: 586933 - DNA, 494 bp, Homo sapiens; identical to SEQ ID NO: 552270
  misc_feature: HIJSMM301CMXJV.47.64.F09.1.454.light.4.raw

SEQ ID NO: 586934 - DNA, 494 bp, Homo sapiens
  misc_feature: HIJSMM301CL6MM.48.10.A10.1.454.light.4.raw
agtatacatacacgaccggtgctcgatttagcgtcgatctcagggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacagaattcactctcaccatcagcggcctgcagtctgatgattttgcaacttatttctgccaacagtatcatacttattctcggaccttcggtccaagggaccgacgggtggaaagtacaaacgaactacgtggctgcgaccactctgtcttt

SEQ ID NO: 586935 - DNA, 526 bp, Homo sapiens
  misc_feature: HIJSMM301AOC69.52.57.F02.1.454.light.4.raw
cgcagtacgacacgaccggtgctcgatttagctcgatatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaacgcccccaaactcatctatttttgaggtcactaagcggccctcaggggtccctgatcgcttctctggctcgaagtctggcaacacggcctccctgaccgtctctgggctccaggctggaggatgaggctgattactactgcacctcatatgcaggcgaacaactaagttttgggggttttcgggcgggagggaccgaaggtgaccgtcctacgtcagcccaaggctcgccccctcggtcactc

SEQ ID NO: 586936 - DNA, 510 bp, Homo sapiens
  misc_feature: HIJSMM301ARVQW.13.3.A03.1.454.light.4.raw
tcacgtactacacgaccggtgctcgatttagagagcgtcacaggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattatttacggggtcaataagcggccctcagggctttctgatcgcttctctggctccaagtctggcaacacggcctccctgacaatctctggactccaggccgaggacgaggctgatttttactgttgttcatatgcaggaaggagtgattatgtctttggaagtgggaccaaggtcaccgtccttggtcagcccaaggcccaacccactgtcactctgttcccg

SEQ ID NO: 586937 - DNA, 505 bp, Homo sapiens
  misc_feature: HIJSMM301EPII4.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaaggctgtccccccg

SEQ ID NO: 586938 - DNA, 491 bp, Homo sapiens
  misc_feature: HIJSMM301DTDQA.48.10.A10.1.454.light.4.raw
agtatacatacacgaccggtgctcgatttagcgtcgatctcaggggagtcagacccagtcaggacacagcatggacatgagggtccccgctcagctcctggggctcctgctgctctggctcccaggtgccaaatgcgacatccagatgacccagtctccgaccaccctgtctgcatctgttggagacagagtcaccatcgcttgccgggccagtcaggacattgaagactggttggcctggtatcaggagaaaccgggcaaagcccctgccctcctcatctataagtcctcaactttagagagtggggtcccatcaagattcagcggcagtggatctggaacaaaattcactctcaccatcagcggcctgcagtctgatgattttgcaacttatttctgccaacagtatcatacttattctcggaccttcggtccaacgggaccacgggtggaaatacaaacgaactagtggctgcaccatctgtcttcta

SEQ ID NO: 586939 - DNA, 505 bp, Homo sapiens
  misc_feature: HIJSMM301C1GYE.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatggaggctgactattactgtgcatcacgggacgcaacatgggatgacaatctgaggcggttgggtgttcggcggagggaccaaactgaccgtcctaggtccagcccaa

SEQ ID NO: 586940 - DNA, 481 bp, Homo sapiens
  misc_feature: HIJSMM301EYFR3.4.74.G08.1.454.light.4.raw
agcactgtagcacgaccggtgctcgatttagtagctctatcagggggcaggagtcagacccactcaggacacagcatggacatgagggtccccgctcagctcctggggctcctgctgctctggctcccaggtgccagatgtgccatccagatggcccagtctccaggttacctgtctgcgtatgtcggagacagagtcaccatcacttgccgggcaagtcaggacatccgaaatgaggtaagctggtatcagcagaaaccagggaaagcccctaagctcctgatctacgctgcgtctagtttacagagtggagtcccatcaaggttcagcggcagtggatctggcacagatttcactctcaccatcagcagcctgcagcctgaggatttgcaacttattactgtctacaagattacacttaccctgggacgttcggccaagggaccaaggtaggaaatacaaacgaactgtggctgcacca

SEQ ID NO: 586941 - DNA, 505 bp, Homo sapiens; identical to SEQ ID NO: 535503
  misc_feature: HIJSMM301AMTTH.8.28.C06.1.454.light.4.raw

SEQ ID NO: 586942 - DNA, 471 bp, Homo sapiens; identical to SEQ ID NO: 537461
  misc_feature: HIJSMM301A8DVR.7.81.H04.1.454.light.4.raw

SEQ ID NO: 586943 - DNA, 504 bp, Homo sapiens; identical to SEQ ID NO: 536385
  misc_feature: HIJSMM301EIQR7.27.78.H01.1.454.light.4.raw

SEQ ID NO: 586944 - DNA, 480 bp, Homo sapiens; identical to SEQ ID NO: 551245
  misc_feature: HIJSMM301DC060.21.25.C03.1.454.light.4.raw

SEQ ID NO: 586945 - DNA, 484 bp, Homo sapiens; identical to SEQ ID NO: 569020
  misc_feature: HIJSMM301C7CTA.40.83.H06.1.454.light.4.raw

SEQ ID NO: 586946 - DNA, 522 bp, Homo sapiens
  misc_feature: HIJSMM301CYV58.27.23.C01.1.454.light.4.raw
  modified_base (518)..(518): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcacgccaaggctcgccccctcggcactctcgttcccnccct

SEQ ID NO: 586947 - DNA, 488 bp, Homo sapiens; identical to SEQ ID NO: 535990
  misc_feature: HIJSMM301DRBD5.11.28.C06.1.454.light.4.raw

SEQ ID NO: 586948 - DNA, 494 bp, Homo sapiens
  misc_feature: HIJSMM301BOMJ5.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaagggaccaggtggagatacaaacgaactgtggctgcaccat

SEQ ID NO: 586949 - DNA, 501 bp, Homo sapiens; identical to SEQ ID NO: 583756
  misc_feature: HIJSMM301BA0QK.18.59.F04.1.454.light.4.raw

SEQ ID NO: 586950 - DNA, 487 bp, Homo sapiens
  misc_feature: HIJSMM301C0PTP.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcggccctgggaccaaagtggatatacaaacgaactgtggctgcaccatctgtt

SEQ ID NO: 586951 - DNA, 478 bp, Homo sapiens
  misc_feature: HIJSMM301DSQB9.40.59.F04.1.454.light.4.raw
tctagcgactcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtatttctgagcgattctctggctccagttctgggaacacagccactctgaccatcagcgggacccaggctatggatgaggctgactattactgtcaggcgtgggacatcagcagtgaggtggttttcggcggagggaccaagctgaccgtcctaagtcagcccg

SEQ ID NO: 586952 - DNA, 502 bp, Homo sapiens; identical to SEQ ID NO: 540196
  misc_feature: HIJSMM301AXBJS.40.45.E01.1.454.light.4.raw

SEQ ID NO: 586953 - DNA, 493 bp, Homo sapiens; identical to SEQ ID NO: 537422
  misc_feature: HIJSMM301DACDN.9.34.D01.1.454.light.4.raw

SEQ ID NO: 586954 - DNA, 506 bp, Homo sapiens; identical to SEQ ID NO: 573729
  misc_feature: HIJSMM301C0EDT.18.78.H01.1.454.light.4.raw

SEQ ID NO: 586955 - DNA, 479 bp, Homo sapiens; identical to SEQ ID NO: 535586
  misc_feature: HIJSMM301D45GW.13.34.D01.1.454.light.4.raw

SEQ ID NO: 586956 - DNA, 486 bp, Homo sapiens; identical to SEQ ID NO: 536165
  misc_feature: HIJSMM301EPIRU.5.71.G05.1.454.light.4.raw

SEQ ID NO: 586957 - DNA, 492 bp, Homo sapiens
  misc_feature: HIJSMM301EXPQT.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtgctgcaccatctgtctt

SEQ ID NO: 586958 - DNA, 497 bp, Homo sapiens; identical to SEQ ID NO: 552457
  misc_feature: HIJSMM301CPW6M.3.33.C11.1.454.light.4.raw

SEQ ID NO: 586959 - DNA, 487 bp, Homo sapiens
  misc_feature: HIJSMM301EH17J.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttccccaccctcctcgacacgcgacgcgtagcgggcggtcggtcggaacggaacggccgactagtag

SEQ ID NO: 586960 - DNA, 487 bp, Homo sapiens; identical to SEQ ID NO: 537079
  misc_feature: HIJSMM301EXPNG.14.55.E11.1.454.light.4.raw

SEQ ID NO: 586961 - DNA, 496 bp, Homo sapiens
  misc_feature: HIJSMM301EAR6S.51.81.H04.1.454.light.4.raw
cgatcgtatacacgaccggtgctcgatttagtagtgtagattcgcgggggggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaaccattggtacttatgtcttcggaactgcgaccaaggtcaccgtcctgggtcagcccaaggccaaccccactgtcactctgtt

SEQ ID NO: 586962 - DNA, 500 bp, Homo sapiens; identical to SEQ ID NO: 542271
  misc_feature: HIJSMM301BL7C2.19.78.H01.1.454.light.4.raw

SEQ ID NO: 586963 - DNA, 448 bp, Homo sapiens; identical to SEQ ID NO: 540364
  misc_feature: HIJSMM301BVZ96.18.9.A09.1.454.light.4.raw

SEQ ID NO: 586964 - DNA, 475 bp, Homo sapiens; identical to SEQ ID NO: 544617
  misc_feature: HIJSMM301A3MS4.13.76.G10.1.454.light.4.raw

SEQ ID NO: 586965 - DNA, 456 bp, Homo sapiens
  misc_feature: HIJSMM301D6MOQ.18.78.H01.1.454.light.4.raw
tacgagtatgcacgaccggtgctcgatttagtgtgagtagtttgggtttgggggctttgcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaaccccactgtcactctcgttcccgccctcctccatactcgta

SEQ ID NO: 586966 - DNA, 502 bp, Homo sapiens; identical to SEQ ID NO: 552832
  misc_feature: HIJSMM301CW5OE.18.11.A11.1.454.light.4.raw

SEQ ID NO: 586967 - DNA, 495 bp, Homo sapiens
  misc_feature: HIJSMM301D18NI.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcagtttattactgtcaacaatattatattattccgaggacgttcggccaaagggaccaaaggttggaaattcaaacgaactagtggctgcacc

SEQ ID NO: 586968 - DNA, 487 bp, Homo sapiens
  misc_feature: HIJSMM301DMRFM.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggaccgttcggccaagggaccaaggtggatatcagacgaa

SEQ ID NO: 586969 - DNA, 506 bp, Homo sapiens
  misc_feature: HIJSMM301ALKB4.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggctccctgaccgtctctgggctccaggctgaggatgaggctgattattactgcagctcatatgcaggcagcagcagtccccatgtgatcttcggcggggggaccaagctgaccgtcctaggtcagcccaaggctgccccccg

SEQ ID NO: 586970 - DNA, 477 bp, Homo sapiens; identical to SEQ ID NO: 543928
  misc_feature: HIJSMM301DMUXW.16.86.H09.1.454.light.4.raw

SEQ ID NO: 586971 - DNA, 512 bp, Homo sapiens; identical to SEQ ID NO: 545961
  misc_feature: HIJSMM301DYB8U.14.78.H01.1.454.light.4.raw

SEQ ID NO: 586972 - DNA, 488 bp, Homo sapiens; identical to SEQ ID NO: 554863
  misc_feature: HIJSMM301BF87Y.12.51.E07.1.454.light.4.raw

SEQ ID NO: 586973 - DNA, 509 bp, Homo sapiens
  misc_feature: HIJSMM301BXJ20.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacacggcctttctgacaatctctcaactccaggctgaagacgaggctatttattactgctcctcatacgcaggtggcacatttttcttggtttttggcggtcgggacccagatgactgtcctcagtcagcccaaggctcgccccctcggt

SEQ ID NO: 586974 - DNA, 474 bp, Homo sapiens; identical to SEQ ID NO: 561309
  misc_feature: HIJSMM301D1DNE.5.12.B01.1.454.light.4.raw

SEQ ID NO: 586975 - DNA, 514 bp, Homo sapiens
  misc_feature: HIJSMM301E2ANS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggtcccaagggaacccaaggtaggaaatacgaaaacgaactaagtggctgcaccaatctgtcttccatctttcccc

SEQ ID NO: 586976 - DNA, 479 bp, Homo sapiens; identical to SEQ ID NO: 535118
  misc_feature: HIJSMM301EKVXV.13.59.F04.1.454.light.4.raw

SEQ ID NO: 586977 - DNA, 480 bp, Homo sapiens; identical to SEQ ID NO: 535291
  misc_feature: HIJSMM301D58J5.22.59.F04.1.454.light.4.raw

SEQ ID NO: 586978 - DNA, 499 bp, Homo sapiens; identical to SEQ ID NO: 549363
  misc_feature: HIJSMM301C963V.9.81.H04.1.454.light.4.raw

SEQ ID NO: 586979 - DNA, 488 bp, Homo sapiens; identical to SEQ ID NO: 535990
  misc_feature: HIJSMM301BNZLE.11.28.C06.1.454.light.4.raw

SEQ ID NO: 586980 - DNA, 490 bp, Homo sapiens
  misc_feature: HIJSMM301DQ5ME.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactatggccgttcacttttggccaggggaccaaactggatatcagacgaactgtggctgca

SEQ ID NO: 586981 - DNA, 490 bp, Homo sapiens; identical to SEQ ID NO: 542820
  misc_feature: HIJSMM301EZ9L6.11.12.B01.1.454.light.4.raw

SEQ ID NO: 586982 - DNA, 488 bp, Homo sapiens
  misc_feature: HIJSMM301EF1ND.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcacttcggtcggagggacgaacggtaggaggatcaaacgaa

SEQ ID NO: 586983 - DNA, 486 bp, Homo sapiens; identical to SEQ ID NO: 536261
  misc_feature: HIJSMM301BM8FC.26.55.E11.1.454.light.4.raw

SEQ ID NO: 586984 - DNA, 484 bp, Homo sapiens
  misc_feature: HIJSMM301AQ83Y.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaacgaactgtggctgcacatctgt

SEQ ID NO: 586985 - DNA, 496 bp, Homo sapiens; identical to SEQ ID NO: 537925
  misc_feature: HIJSMM301BWNL2.22.14.B03.1.454.light.4.raw

SEQ ID NO: 586986 - DNA, 483 bp, Homo sapiens
  misc_feature: HIJSMM301EYZWR.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacga

SEQ ID NO: 586987 - DNA, 507 bp, Homo sapiens; identical to SEQ ID NO: 549725
  misc_feature: HIJSMM301AYMAS.18.78.H01.1.454.light.4.raw

SEQ ID NO: 586988 - DNA, 506 bp, Homo sapiens; identical to SEQ ID NO: 534969
  misc_feature: HIJSMM301D0JWT.18.37.D04.1.454.light.4.raw

SEQ ID NO: 586989 - DNA, 466 bp, Homo sapiens; identical to SEQ ID NO: 535366
  misc_feature: HIJSMM301CXXPD.13.4.A04.1.454.light.4.raw

SEQ ID NO: 586990 - DNA, 494 bp, Homo sapiens; identical to SEQ ID NO: 550746
  misc_feature: HIJSMM301A5XCH.26.12.B01.1.454.light.4.raw

SEQ ID NO: 586991 - DNA, 492 bp, Homo sapiens
  misc_feature: HIJSMM301A59JV.21.65.F10.1.454.light.4.raw
tcgtcgctcgcacgaccggtgctcgatttagctacgctctaagggggaggaactgctcagttaggacccagacggaaccatggaagccccagcgcagcttctcttcctcctgctactctggctcccagaaagctctggagaaatagtgatgacgcagtctccagccaccctgtctgtgtctccaggggagagagccaccctctcctgcagggccagtcagagtgttagcagcaacttagcctggtaccagcagaaacctggccagcctcccaggctcctcatctatggtgcatccgccagggccactggaatcccagccaggttcagtggcactgggtctgggacagagttcactctcaccatcagcagcctgcagtctgaagtattttgaagtttatttctgtctgcagtacaatcagtggcctcggacgttcggccaagggaccaaggtggaaagtcaaacgaactagtggctgcaccatctgtcttcta

SEQ ID NO: 586992 - DNA, 505 bp, Homo sapiens
  misc_feature: HIJSMM301BJ91L.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactggaccgttcctaggtcaggcccaa

SEQ ID NO: 586993 - DNA, 454 bp, Homo sapiens; identical to SEQ ID NO: 535005
  misc_feature: HIJSMM301DUKAV.19.86.H09.1.454.light.4.raw

SEQ ID NO: 586994 - DNA, 502 bp, Homo sapiens
  misc_feature: HIJSMM301B79XC.49.87.H10.1.454.light.4.raw
agtcgagagacacgaccggtgctcgatttagcagtactgcgttgggtttgggggctgtgggtccaggaggcagaactctgggtgtctcaccatggcctggatccctctacttctccccctcctcactctctgcacaggctctgaggcctcctctgaattgcaacagacatcctcggtgtcagcgtccccaggacagacggccagaattacttgctctggagatgcattggcgaaacaatttgcttcttggttccagcagaagccaggccaagcccctatcttgatgatctataaaggctctgagaggccctcagggatccctgagcgattctctgggtcccactcaggggccacagccgtgttgaccatcactggagtccaggcagaagacgaggctgactattattgtcagtcagccgacaacactattgtctccgtgtttttcggcggtagggaccaggctgaccgtcctggtcagcccaaggctgccccctcggtctac

SEQ ID NO: 586995 - DNA, 507 bp, Homo sapiens; identical to SEQ ID NO: 538063
  misc_feature: HIJSMM301DOGCG.47.85.H08.1.454.light.4.raw

SEQ ID NO: 586996 - DNA, 497 bp, Homo sapiens
  misc_feature: HIJSMM301CH3AZ.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggtcggaggggaccgagggtgggaggatcagacgaactagtggctgcaccatctgtt

SEQ ID NO: 586997 - DNA, 500 bp, Homo sapiens
  misc_feature: HIJSMM301BV9NO.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccagggtggaaatacaaacgaaacgtagtggctgcaccatctgtcttctatt

SEQ ID NO: 586998 - DNA, 523 bp, Homo sapiens
  misc_feature: HIJSMM301DHFA0.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgcctccc

SEQ ID NO: 586999 - DNA, 480 bp, Homo sapiens
  misc_feature: HIJSMM301AG28K.22.59.F04.1.454.light.4.raw
acatacgcgtcacgaccggtgctcgatttagtacacacacttagggattgggggaggaactgctcagttaggacccagacggaaccatggaagccccagcgcagcttctcttcctcctgctactctggctcccagtttaagataccactggagaaatagtgatgacgcagtctccagccaccctgtctgtgtctccaggggaaagagccacactctcctgcagggccagtcagagtgttagcagcagcttagcctggtaccagcagaaacctggccaggctcccaggctcctcatctatggtgcatctacgagggccactggtatcccagccaggttcagtggcagtgggtctgggacagagttcactctcaccatcagcagcctgcagtctgaagattttgcagtttattactgtcagcactataataactggcctccgtacagttttggccaggggaccaagctggagatcaaacgaa

SEQ ID NO: 587000 - DNA, 503 bp, Homo sapiens
  misc_feature: HIJSMM301B4U4M.3.71.G05.1.454.light.4.raw
  modified_base (420)..(420): a, c, t, g, unknown or other
  modified_base (435)..(435): a, c, t, g, unknown or other
  modified_base (483)..(483): a, c, t, g, unknown or other
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctaatggtaaaaaacaaccggccctcagggatcccagaccgattctctggctccagctcaggaaacacagcttccttgaccatcactggggctcaggcgaagatgaggctgactattactgtaactcccgggccagcaagnggtaacaattgtganattcgcggaggaaccaaggtgaccgtcctacgtcacaccgaacggtcnccggccccctcggtacctac

SEQ ID NO: 587001 - DNA, 475 bp, Homo sapiens; identical to SEQ ID NO: 572572
  misc_feature: HIJSMM301B07VK.11.76.G10.1.454.light.4.raw

SEQ ID NO: 587002 - DNA, 508 bp, Homo sapiens
  misc_feature: HIJSMM301DZD6R.8.42.D09.1.454.light.4.raw
  modified_base (502)..(502): a, c, t, g, unknown or other
ctcgcgtgtccacgaccggtgctcgatttagacacatacgcagggaaagggggggtctcaggaggcagcgctctcaggacgtcaccaccatggcctgggctctgctcctcctcaccctcctcactcagggcacagggtcctggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctgccccctcggtcactctgttcccncctccc

SEQ ID NO: 587003 - DNA, 517 bp, Homo sapiens
  misc_feature: HIJSMM301ETTZ6.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccgccctcctcacg

SEQ ID NO: 587004 - DNA, 512 bp, Homo sapiens
  misc_feature: HIJSMM301AP1V2.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttcggtccgaagggaccgaaggtggaaagtcaaacgaactacgtggcgtgcaccatctgtcttctatctttcccg

SEQ ID NO: 587005 - DNA, 488 bp, Homo sapiens; identical to SEQ ID NO: 536554
  misc_feature: HIJSMM301EK6F4.26.37.D04.1.454.light.4.raw

SEQ ID NO: 587006 - DNA, 503 bp, Homo sapiens; identical to SEQ ID NO: 549080
  misc_feature: HIJSMM301D9XLV.53.49.E05.1.454.light.4.raw

SEQ ID NO: 587007 - DNA, 490 bp, Homo sapiens
  misc_feature: HIJSMM301BJTK8.43.60.F05.1.454.light.4.raw
tgtgagtagtcacgaccggtgctcgatttagtacgtcatcagggaaaggggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagttcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccgacgggaccgacggtcggagtgtcaagacgaactgtggctgcaccat

SEQ ID NO: 587008 - DNA, 492 bp, Homo sapiens
  misc_feature: HIJSMM301DEKZE.13.39.D06.1.454.light.4.raw
tcacgtactacacgaccggtgctcgatttagtgacatctcgcagttctttgggggctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattatagtactcctccgaggctcactttcggcggagggaccaaggtggaggatcaaacgaa

SEQ ID NO: 587009 - DNA, 494 bp, Homo sapiens
  misc_feature: HIJSMM301DOLJH.16.6.A06.1.454.light.4.raw
tgtactactccacgaccggtgctcgatttagatctactgacagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccagagtgtcttatacagctccaacaataagaattacttagcttggtaccagcagaaaccggggcagtctcctaagttgctcatttactgggcgtctacccgggaatccggggtccctgaccgattcagtggcagcgggtctgggacagatttcactctcaccatcagcagcctgcaggttgaagatgtggcagtttattactgtcagcagtattatactactcctctgacgttcggccaaggaccaaggtggaggatcaaacgaactgtggctgcaccat

SEQ ID NO: 587010 - DNA, 482 bp, Homo sapiens
  misc_feature: HIJSMM301CDNOU.51.52.E08.1.454.light.4.raw
cgatcgtatacacgaccggtgctcgatttagtcgagctctcagagagaaagggggtaggctcaggaggcagagctctgattgtctcaccatggcctggatccctctcctgctccccctcctcattctctgcacagtctctgtggcctcctatgagctgacacagccatactcagtgtcagtgtctccgggacagacagccaggatcacctgctcaggagatgtactgggaaaaaatatgctcgttggttccagcagaaggcgggccaggcccctgtcttgatgatttataaagacactgagcggccctcagggatccctgagcgattctccggctccagctcagggactacagtcaccttgaccatcagcggggcccaggttgacgatgaggctgactattactgttactctgcggctgacaacaattctggatattcggcggagggaccaagctgaccgtcttaggtcagcccaaggctcg

SEQ ID NO: 587011 - DNA, 498 bp, Homo sapiens
  misc_feature: HIJSMM301CTX06.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaaggaccgaaggtaggagtatcagacgaactagtggctg

SEQ ID NO: 587012 - DNA, 489 bp, Homo sapiens
  misc_feature: HIJSMM301A4SVW.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccagattccaccggagacattgttttgacacagtctccagccaccctgtctttgtctccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccaggggtggagatcagacgaactgtggctgcaccatct

SEQ ID NO: 587013 - DNA, 509 bp, Homo sapiens; identical to SEQ ID NO: 541829
  misc_feature: HIJSMM301E0NPL.17.28.C06.1.454.light.4.raw

SEQ ID NO: 587014 - DNA, 521 bp, Homo sapiens; identical to SEQ ID NO: 538715
  misc_feature: HIJSMM301AYTDT.27.23.C01.1.454.light.4.raw

SEQ ID NO: 587015 - DNA, 500 bp, Homo sapiens; identical to SEQ ID NO: 568876
  misc_feature: HIJSMM301D3M8Y.52.53.E09.1.454.light.4.raw

SEQ ID NO: 587016 - DNA, 461 bp, Homo sapiens
  misc_feature: HIJSMM301C2YS7.43.66.F11.1.454.light.4.raw
tgtgagtagtcacgaccggtgctcgattttagtcacgcgagaagggggaagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttcccgccatctgaactactcaca

SEQ ID NO: 587017 - DNA, 520 bp, Homo sapiens
  misc_feature: HIJSMM301ERK2A.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgccacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggccccaggcagacgatgaatgtgattatcactgcgtcctttatgtggggcgtggcatttgggtgttcggcggagggaccaaactgaccgtcctaggtcacg

SEQ ID NO: 587018 - DNA, 491 bp, Homo sapiens
  misc_feature: HIJSMM301BVLS3.43.49.E05.1.454.light.4.raw
tgtgagtagtcacgaccggtgctcgatttagagcgactagcaacacacaaaggggaagagctgctcagttaggacccagagggaaccatggaaaccccagcgcagcttctcttcctcctgctactctggctcccagataccaccggagaaattgtgttgacgcagtctccgggcaccctgtctttgtctccaggggatagagccaccctctcctgcagggccagtcagagtgttagcagcacctacttagcctggtaccagcagaaacctggccaggctcccaggctcctcatctatgatgcatccagcagggccactggcatcccagacaggttcagtggcagtgggtctgggacagacttcactctcaccatcagcagactggagcctgaagattttgcagtgtattactgtcaccagtatggtagctcacctaagacgttcggaccgaagggaccaaggtggaaatacaaacgaactgtggctgcacc

SEQ ID NO: 587019 - DNA, 513 bp, Homo sapiens; identical to SEQ ID NO: 561323
  misc_feature: HIJSMM301AH4YM.43.19.B08.1.454.light.4.raw

SEQ ID NO: 587020 - DNA, 484 bp, Homo sapiens; identical to SEQ ID NO: 535211
  misc_feature: HIJSMM301C7J0O.47.46.E02.1.454.light.4.raw

SEQ ID NO: 587021 - DNA, 500 bp, Homo sapiens; identical to SEQ ID NO: 539563
  misc_feature: HIJSMM301BGJG0.8.2.A02.1.454.light.4.raw

SEQ ID NO: 587022 - DNA, 463 bp, Homo sapiens; identical to SEQ ID NO: 535062
  misc_feature: HIJSMM301BJCO9.11.73.G07.1.454.light.4.raw

SEQ ID NO: 587023 - DNA, 487 bp, Homo sapiens; identical to SEQ ID NO: 539157
  misc_feature: HIJSMM301ALP8A.26.37.D04.1.454.light.4.raw

SEQ ID NO: 587024 - DNA, 517 bp, Homo sapiens
  misc_feature: HIJSMM301E3SVD.8.28.C06.1.454.light.4.raw
ctcgcgtgtccacgaccggtgctcgatttagagctcacgtattgggtttggggggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgactttgcagttatttctgtcagcagtctgaagactggccgttcacttcggtcggagggacgaacggtaggaccgtacaacgaaacctagtggcgtgcaccaactctgtcttctactcgttccctccact

SEQ ID NO: 587025 - DNA, 460 bp, Homo sapiens
  misc_feature: HIJSMM301DO9NQ.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagagactccaacatcggcgatactcatgtgtactggtaccaacaggtcccagggacggcccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgccccctcggtcactctgttcccaccctcctcacgcgtatgt

SEQ ID NO: 587026 - DNA, 487 bp, Homo sapiens; identical to SEQ ID NO: 535583
  misc_feature: HIJSMM301D9XG3.22.73.G07.1.454.light.4.raw

SEQ ID NO: 587027 - DNA, 498 bp, Homo sapiens
  misc_feature: HIJSMM301ASV6P.52.42.D09.1.454.light.4.raw
  modified_base (238)..(238): a, c, t, g, unknown or other
cgcagtacgacacgaccggtgctcgatttagacacatacgcagggaaagggggctgtgggtccaggaggcagaactctgggtgtctcaccatggcctggatccctctacttctccccctcctcactctctgcacaggctctgaggcctcctatgagctgacacagccaccctcggtgtcagtgtcccccaggacagacggccaggatcacctgctctggagatgcattgccaaaccgntatgcttattggtaccagcagaagccgggcccaggccccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctggtcagccaacggccgaaccccactcgt

SEQ ID NO: 587028 - DNA, 520 bp, Homo sapiens
  misc_feature: HIJSMM301DZEGJ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggagggaccaggctgaccgtcctaggtcagccaaggctgccccctcggtcactctgttcccacct

SEQ ID NO: 587029 - DNA, 485 bp, Homo sapiens; identical to SEQ ID NO: 540084
  misc_feature: HIJSMM301AKXR4.47.78.H01.1.454.light.4.raw
  modified_base (467)..(467): a, c, t, g, unknown or other

SEQ ID NO: 587030 - DNA, 495 bp, Homo sapiens
  misc_feature: HIJSMM301BG9CN.10.33.C11.1.454.light.4.raw
catagtagtgcacgaccggtgctcgatttagagtgagctcgttgggtttggggggagtcagtcccaaccaggacacagcatggacatgagggtccctgctcagctcctggggctcctgctcctctggctctcgggtgtcagatgtgacatccagatgacccagtctccatcctccctgtatgcatctgtaggagacagcgtcaccatcacttgccgggcgagtcaggacatttacaagtctttaaattggtatcagcagaaaccagggaaggcccctaaactcctgatctacgatgcatcgaacttggaaacaggggtcccatcaaggttcagtggaggtggatctgggacagattttactctcggcatccgcagcctgcagcctgaagattttgcgacatattactgtcaacagtatgaaaatgtccgctcactttcggcgggggaccgaaggtggagttcaaacgaactgtggctgcaccatctgtcttcatt

SEQ ID NO: 587031 - DNA, 485 bp, Homo sapiens; identical to SEQ ID NO: 535501
  misc_feature: HIJSMM301A199U.3.10.A10.1.454.light.4.raw

SEQ ID NO: 587032 - DNA, 500 bp, Homo sapiens
  misc_feature: HIJSMM301B7028.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctgcccctcgtcacttctgttccccg

SEQ ID NO: 587033 - DNA, 503 bp, Homo sapiens
  misc_feature: HIJSMM301A63HO.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctccaagtctggcaacacggcctccctgaccgtctctgggctccagactgaggatgaggctgactattactgcagctcatttgcaggcagccgtatactcttcggcggagggaccaagctgaccgtcctagtcagcccaaggctgccccctcggtcta

SEQ ID NO: 587034 - DNA, 507 bp, Homo sapiens
  misc_feature: HIJSMM301BBY7U.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataatttctgggtgttcggcggagggaccaaactgaccgtcctaggtcagcccaaggctcgccccctcggtcactctcgtt

SEQ ID NO: 587035 - DNA, 504 bp, Homo sapiens; identical to SEQ ID NO: 538423
  misc_feature: HIJSMM301DC5WR.48.67.G01.1.454.light.4.raw

SEQ ID NO: 587036 - DNA, 494 bp, Homo sapiens
  misc_feature: HIJSMM301AS6H2.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcgtcacggacgacggtcggagtgtctaagcgaacgtacgtggcgtgcgaccactcttcg

SEQ ID NO: 587037 - DNA, 507 bp, Homo sapiens
  misc_feature: HIJSMM301AXIQJ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggagtatcaaacgaactgtggcgtgcaccatctgtctt

SEQ ID NO: 587038 - DNA, 473 bp, Homo sapiens; identical to SEQ ID NO: 544382
  misc_feature: HIJSMM301EMYJ0.11.76.G10.1.454.light.4.raw

SEQ ID NO: 587039 - DNA, 464 bp, Homo sapiens
  misc_feature: HIJSMM301A7VZP.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaaatctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 587040 - DNA, 504 bp, Homo sapiens; identical to SEQ ID NO: 545953
  misc_feature: HIJSMM301DQYXQ.8.28.C06.1.454.light.4.raw

SEQ ID NO: 587041 - DNA, 506 bp, Homo sapiens; identical to SEQ ID NO: 536355
  misc_feature: HIJSMM301B0DEF.47.85.H08.1.454.light.4.raw

SEQ ID NO: 587042 - DNA, 447 bp, Homo sapiens
  misc_feature: HIJSMM301DP682.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctggctattactgccagtcctatgacatgaggctgagtggttcgtatgtcttcggatctgggaccaaggtcaccgtcctaagtcagcccaaggccaacccctctgtcactctgttcccaccctcctccatactcgta

SEQ ID NO: 587043 - DNA, 447 bp, Homo sapiens; identical to SEQ ID NO: 535020
  misc_feature: HIJSMM301EQ7L7.18.9.A09.1.454.light.4.raw

SEQ ID NO: 587044 - DNA, 483 bp, Homo sapiens
  misc_feature: HIJSMM301AI3OA.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcaccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 587045 - DNA, 483 bp, Homo sapiens
  misc_feature: HIJSMM301B6KLL.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaacggtggagatcaaacgaactgtggctgcaccat

SEQ ID NO: 587046 - DNA, 487 bp, Homo sapiens; identical to SEQ ID NO: 538190
  misc_feature: HIJSMM301DIZDI.47.70.G04.1.454.light.4.raw

SEQ ID NO: 587047 - DNA, 513 bp, Homo sapiens
  misc_feature: HIJSMM301ERSPB.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggtatcaacaacagccggagaagggcctcgctacttaatgaagattggccattttggcagccaccacaagggggtcggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctcggtcactctgttcccaccctcctc

SEQ ID NO: 587048 - DNA, 487 bp, Homo sapiens
  misc_feature: HIJSMM301EA8JM.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccggtggaggctgaggacgttggaatttattactgtatgcaaggtatagagcttcctccgacgttcgccgaaggaccgaaggtggaactacaaacgaa

SEQ ID NO: 587049 - DNA, 459 bp, Homo sapiens; identical to SEQ ID NO: 541801
  misc_feature: HIJSMM301DPZ3A.22.28.C06.1.454.light.4.raw

SEQ ID NO: 587050 - DNA, 481 bp, Homo sapiens
  misc_feature: HIJSMM301ALZJY.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcacctcagcctccctggtcatcgctgggctccaggctgacgatgaggctgattatattgccagtcctatgacaacaccctgcgtggtttttggctgttcggcggcgggacc

SEQ ID NO: 587051 - DNA, 504 bp, Homo sapiens; identical to SEQ ID NO: 551974
  misc_feature: HIJSMM301DGPLY.19.78.H01.1.454.light.4.raw

SEQ ID NO: 587052 - DNA, 491 bp, Homo sapiens; identical to SEQ ID NO: 536211
  misc_feature: HIJSMM301DEKZL.16.53.E09.1.454.light.4.raw

SEQ ID NO: 587053 - DNA, 487 bp, Homo sapiens
  misc_feature: HIJSMM301CAPLM.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccagggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttgccaagggaccaagctgagatcaaacgaactgtggctgcacca

SEQ ID NO: 587054 - DNA, 493 bp, Homo sapiens; identical to SEQ ID NO: 540880
  misc_feature: HIJSMM301DQKJ8.40.81.H04.1.454.light.4.raw

SEQ ID NO: 587055 - DNA, 509 bp, Homo sapiens
  misc_feature: HIJSMM301DEPMD.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtcgtcccccggacgttcggtccgacgggacgacagtacgaaatagagacgaactagtggctgcaccatctgtcttctatcttcccgt

SEQ ID NO: 587056 - DNA, 508 bp, Homo sapiens
  misc_feature: HIJSMM301EV1TR.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactgggctcaggcggaagatgaggctgactattattgtaagtccggggacagaagtggtaattacatggtgttcggcggagggaccaagctgaccgtcctacgtcagcccaaggctgccccctcggtcactctcg

SEQ ID NO: 587057 - DNA, 480 bp, Homo sapiens; identical to SEQ ID NO: 549459
  misc_feature: HIJSMM301CVF4A.21.25.C03.1.454.light.4.raw

SEQ ID NO: 587058 - DNA, 500 bp, Homo sapiens
  misc_feature: HIJSMM301C4W79.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccgaaggaccgaaggtggaatacaaacgaactagtggctgcacc

SEQ ID NO: 587059 - DNA, 502 bp, Homo sapiens; identical to SEQ ID NO: 584199
  misc_feature: HIJSMM301CH9ZS.51.23.C01.1.454.light.4.raw

SEQ ID NO: 587060 - DNA, 453 bp, Homo sapiens; identical to SEQ ID NO: 544521
  misc_feature: HIJSMM301B6YUD.19.86.H09.1.454.light.4.raw

SEQ ID NO: 587061 - DNA, 491 bp, Homo sapiens
  misc_feature: HIJSMM301CSA8E.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactgtggctgcaccatctgtt

SEQ ID NO: 587062 - DNA, 492 bp, Homo sapiens
  misc_feature: HIJSMM301EDKBQ.40.37.D04.1.454.light.4.raw
tctagcgactcacgaccggtgctcgatttagtagcatactgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaggtccagccggactgttctatacagcttcaacaataagaactctgtggcttggtaccagcacaaaccaggacagcctcccaagctgctcattgactgggcatctacccggggatccggggtccctgaccgattcagtggcagcgggtctgggacagatttcactctcaccatcaccagcctgcaggctgaagatgtggcggtttattactgtcaacaatattctggtcaatctcattctttcggcggagggaccaaggtggagatcagacgaactgtgg

SEQ ID NO: 587063 - DNA, 489 bp, Homo sapiens; identical to SEQ ID NO: 535139
  misc_feature: HIJSMM301BRG88.14.55.E11.1.454.light.4.raw

SEQ ID NO: 587064 - DNA, 523 bp, Homo sapiens
  misc_feature: HIJSMM301BXIIY.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccgaggctgaccgtcctaggtcagcccaaggctgccccctcggtcactctcgttcccaccct

SEQ ID NO: 587065 - DNA, 362 bp, Homo sapiens
  misc_feature: HIJSMM301BN1GE.19.26.C04.1.454.light.4.raw
tactctcgtgcacgaccggtgctcgatttagtctagcgactttgggtttggggggtgtggtggtctccactcccgccttgacggggctgttatctgccttccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatgtgattttcggcggagggaccaagctgaccgtcctaggtcagcccaaggctgccccctcggtcactctgttcccgccctcctccacgagagta

SEQ ID NO: 587066 - DNA, 510 bp, Homo sapiens
  misc_feature: HIJSMM301DXX4T.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacattttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggccaggctgaccgtcctaagtcagcccaaggctcgccccctc

SEQ ID NO: 587067 - DNA, 485 bp, Homo sapiens; identical to SEQ ID NO: 536075
  misc_feature: HIJSMM301ECWMW.17.21.B10.1.454.light.4.raw

SEQ ID NO: 587068 - DNA, 486 bp, Homo sapiens; identical to SEQ ID NO: 535043
  misc_feature: HIJSMM301CNISH.46.35.D02.1.454.light.4.raw

SEQ ID NO: 587069 - DNA, 497 bp, Homo sapiens; identical to SEQ ID NO: 536371
  misc_feature: HIJSMM301CMSWH.16.78.H01.1.454.light.4.raw

SEQ ID NO: 587070 - DNA, 483 bp, Homo sapiens
  misc_feature: HIJSMM301D058S.3.88.H11.1.454.light.4.raw
agacgcactccacgaccggtgctcgatttagcgacagcgagaacacacaaagggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccactttgcaaactggggtcccatccaggttcagcggcaggggatctgggacagatttcactctcaccatcagcagcctgcagcctgaagatttgcaacttactattgtcaacaggctaacagtttccctttaatcttcggccaagggacacgactggagattaaacgaactgtggctgcacc

SEQ ID NO: 587071 - DNA, 504 bp, Homo sapiens
  misc_feature: HIJSMM301B91FD.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttccggccctgggaccaagtggatatcaaacgaactgtggctgcaccatctgtt

SEQ ID NO: 587072 - DNA, 509 bp, Homo sapiens; identical to SEQ ID NO: 541829
  misc_feature: HIJSMM301BXGH7.17.28.C06.1.454.light.4.raw

SEQ ID NO: 587073 - DNA, 476 bp, Homo sapiens
  misc_feature: HIJSMM301A38DR.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagattttcactctcgccatcagtagtctgcaacctgatgattttgcaacttactactgtcaacagagttccactaccccaatcacttcggccctgggactgaagtgcatatgaagagaactgtggctgca

SEQ ID NO: 587074 - DNA, 494 bp, Homo sapiens; identical to SEQ ID NO: 534992
  misc_feature: HIJSMM301BGSOY.9.1.A01.1.454.light.4.raw

SEQ ID NO: 587075 - DNA, 497 bp, Homo sapiens; identical to SEQ ID NO: 536376
  misc_feature: HIJSMM301EV0MU.22.9.A09.1.454.light.4.raw

SEQ ID NO: 587076 - DNA, 444 bp, Homo sapiens; identical to SEQ ID NO: 535192
  misc_feature: HIJSMM301B4G3R.5.9.A09.1.454.light.4.raw

SEQ ID NO: 587077 - DNA, 497 bp, Homo sapiens
  misc_feature: HIJSMM301EKGBE.40.42.D09.1.454.light.4.raw
tctagcgactcacgaccggtgctcgatttagacacatacgcagggaaagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagaagcattgaccaaaaaaatatgcttattggtaccaacagaagtcaggccaggcccctgtgctggtcatctatgaggacaacaaacgaccctccgagatccctgagagattctctggctccagctcagggacaatggccaccttggctctcagtgggcccaggtggaggatgaagctgactactactgttactcagtggacagcagtggaaatcatgggtattcggcggagggaccaagctgaccgtcctaggtcagcccaaggctgccccctcggtcact

SEQ ID NO: 587078 - DNA, 487 bp, Homo sapiens
  misc_feature: HIJSMM301C4OCT.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtctaggtcagaccccg

SEQ ID NO: 587079 - DNA, 499 bp, Homo sapiens; identical to SEQ ID NO: 551769
  misc_feature: HIJSMM301DKXSG.43.34.D01.1.454.light.4.raw

SEQ ID NO: 587080 - DNA, 516 bp, Homo sapiens
  misc_feature: HIJSMM301ATZXX.9.2.A02.1.454.light.4.raw
tgatacgtctcacgaccggtgctcgatttagactcatctacaggggggggtctcaggaggcagcgctctcgggacgtctccaccatggcctgggctctgctattcctcaccctcctcactcagtgtacagggtcctgggcccagtccgccctgactcagcctgccgccgtgtccgggtctcctggacagtcgatcaccatctcgtgcactggaacgaatagcgacattggtggctctaatcatgtctcctggtactataacagtccaggcaaagcccccaaactcataatttatgatgtctttagacggccctcagggatttcttctcggttgtctggctccaagtctgggaacacggcctccctgaccatctctggacttcagcctgaggacgagggtgattacttctgcagttcagattcagaaacttcccctcgttgggtgttcggcggagggaccatgctgaccgtcctgagtcagcccaaggctgccccctcggtcactctgttcccacct

SEQ ID NO: 587081 - DNA, 464 bp, Homo sapiens; identical to SEQ ID NO: 536640
  misc_feature: HIJSMM301AD5RK.26.78.H01.1.454.light.4.raw

SEQ ID NO: 587082 - DNA, 507 bp, Homo sapiens
  misc_feature: HIJSMM301BY1IW.8.28.C06.1.454.light.4.raw
ctcgcgtgtccacgaccggtgctcgatttagagctcacgtattgggtttgggggaggaactgctcagttaggacccagacggaaccatggaagccccagcgcagcttctcttcctcctgctactctggctcccagagatcattggagaagtggtgatgacacagtctccggtcaccctgtctgtttttcctggggagagagccaccctctcctgtgcggccagtcagagcgttaggacgaacttagcctggtatcagcagaggcctggccaggctcccagactcctcatctttggcgcctttaacagggccagtggaatcccagccaggttcagcggcagtgggtctgggacttcgttcactctcaccatcaataacctgcaatctgacgtactttgctagtttatttctgtcagcagtctgaagactggccgttcactttcggcggagggaccaaggtggacctcaaacgaactgtggctgcaccatctgtcttcatcttcccgcc

SEQ ID NO: 587083 - DNA, 508 bp, Homo sapiens
  misc_feature: HIJSMM301BLW3A.16.46.E02.1.454.light.4.raw
tgtactactccacgaccggtgctcgatttagactcatctacagggaaagggggggagtctcaggaggcagctctctcggaatatctccaccatggcctgggcgtctgctcctcctcaccctcctcactcagggcgacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccacccactgtcact

SEQ ID NO: 587084 - DNA, 504 bp, Homo sapiens; identical to SEQ ID NO: 560731
  misc_feature: HIJSMM301CNWO6.5.24.C02.1.454.light.4.raw

SEQ ID NO: 587085 - DNA, 504 bp, Homo sapiens; identical to SEQ ID NO: 580977
  misc_feature: HIJSMM301AE53E.48.38.D05.1.454.light.4.raw

SEQ ID NO: 587086 - DNA, 509 bp, Homo sapiens
  misc_feature: HIJSMM301DPTAD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaccgaaggtaggaaatacaaacgaactagtggctgcaccactctcgtcttctatcttccccg

SEQ ID NO: 587087 - DNA, 513 bp, Homo sapiens
  misc_feature: HIJSMM301A5HV3.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcgccgacgggacgacgacgtagaaatagagacgaacgtacgtggcgtgcgaccactactgtcttctactcttcccgt

SEQ ID NO: 587088 - DNA, 493 bp, Homo sapiens; identical to SEQ ID NO: 535047
  misc_feature: HIJSMM301DVC49.16.53.E09.1.454.light.4.raw

SEQ ID NO: 587089 - DNA, 513 bp, Homo sapiens
  misc_feature: HIJSMM301EYINW.48.57.F02.1.454.light.4.raw
agtatacatacacgaccggtgctcgatttagctcgatatagttgggtttgggggtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctcgccccctcggtcactctgttcccaccct

SEQ ID NO: 587090 - DNA, 503 bp, Homo sapiens; identical to SEQ ID NO: 538884
  misc_feature: HIJSMM301AGN9N.27.78.H01.1.454.light.4.raw

SEQ ID NO: 587091 - DNA, 473 bp, Homo sapiens
  misc_feature: HIJSMM301AHEIN.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactacccctctcactttcggcggggggaccgaaggtggagatcaacgaa

SEQ ID NO: 587092 - DNA, 500 bp, Homo sapiens
  misc_feature: HIJSMM301BXSEL.40.36.D03.1.454.light.4.raw
tctagcgactcacgaccggtgctcgatttagctgcgtcacgatctctcttgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaagctgctcatttactcggcatccacccggaaatccggagttcctgaccgattccgtggcagcgggtctgggacagattttactctcaccatcagtagcctgcaggctgaagatgtggcagtttattactgtcaacaatattattatactccgccgacgttcggccgggggaccgaacgtggaaatacaaacgaactgtggctgca

SEQ ID NO: 587093 - DNA, 498 bp, Homo sapiens
  misc_feature: HIJSMM301DLOMK.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgtcgtccaggaccgaaacgtaggacgatcaagacgaactacgtggcgtgcgaccactctgtt

SEQ ID NO: 587094 - DNA, 505 bp, Homo sapiens
  misc_feature: HIJSMM301CGGWU.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaatcagcagggtggaggctgaggatgttggggtttattactgcatgcaactacacacggccgctcactttcggcggagggaccgaaggtggagatcaaacgaactgtggctgcaccatctgtt

SEQ ID NO: 587095 - DNA, 502 bp, Homo sapiens
  misc_feature: HIJSMM301DH8A2.5.86.H09.1.454.light.4.raw
atcagacacgcacgaccggtgctcgatttagtgctatagacttgggtttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactgggaccagcagtgacattggtcgttataactatgtctcctggtaccaacaacatccaggcaaagcccccaaactcgtgatttctgaggtcagtaagcggccctcaggggtccctgatcgcttctctggctcaagtctggcaacacggcctccctgaccgtctctgggctccagactgaggatgaggctgactattactgcagctcatttgcaggcagccgtatactcttcggcggagggaccaagctgaccgtcctaggtcagcccaaggctgccccctcggtca

SEQ ID NO: 587096 - DNA, 349 bp, Homo sapiens; identical to SEQ ID NO: 550652
  misc_feature: HIJSMM301D7DEY.12.53.E09.1.454.light.4.raw

SEQ ID NO: 587097 - DNA, 511 bp, Homo sapiens
  misc_feature: HIJSMM301D7YXV.8.33.C11.1.454.light.4.raw
ctcgcgtgtccacgaccggtgctcgatttagagtgagctcgttgggtttgggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtgggtatgggacagacttcactctcaccatcatcagcctggagcctgaagatgttgcagtttattactgtcaacatcgtaccgagtggcctccgggggccactttccggccctcgggaccaaggtggagatacaaacgaactgtggctgcaccatctgtcttcta

SEQ ID NO: 587098 - DNA, 479 bp, Homo sapiens; identical to SEQ ID NO: 535586
  misc_feature: HIJSMM301DRARC.13.34.D01.1.454.light.4.raw

SEQ ID NO: 587099 - DNA, 490 bp, Homo sapiens; identical to SEQ ID NO: 535234
  misc_feature: HIJSMM301AS1IG.17.21.B10.1.454.light.4.raw

SEQ ID NO: 587100 - DNA, 517 bp, Homo sapiens
  misc_feature: HIJSMM301EAHMY.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggtttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttcccg

SEQ ID NO: 587101 - DNA, 501 bp, Homo sapiens
  misc_feature: HIJSMM301CXV50.22.65.F10.1.454.light.4.raw
  modified_base (478)..(478): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtcgccccccgactctacctcgtcgaacggacgacgactgtagataacgtaaactagtggtcgngcaccaactctcgttcttctctt

SEQ ID NO: 587102 - DNA, 488 bp, Homo sapiens; identical to SEQ ID NO: 541987
  misc_feature: HIJSMM301C3ZLM.8.12.B01.1.454.light.4.raw

SEQ ID NO: 587103 - DNA, 487 bp, Homo sapiens; identical to SEQ ID NO: 576526
  misc_feature: HIJSMM301BVQ1R.41.10.A10.1.454.light.4.raw

SEQ ID NO: 587104 - DNA, 454 bp, Homo sapiens; identical to SEQ ID NO: 534964
  misc_feature: HIJSMM301AZBW6.19.86.H09.1.454.light.4.raw

SEQ ID NO: 587105 - DNA, 513 bp, Homo sapiens
  misc_feature: HIJSMM301EALMI.7.34.D01.1.454.light.4.raw
cgtgtctctacacgaccggtgctcgatttagatcgtctgtgttggggtttggggggggtctcaggagggcagcgctctcgggacgtctccaccatggcctgggctctgctattcctctccctcctcactcagggcacagggtcctgggcccagtctgccctgactcaacctgcctccgtgtctgggtcacctggacagtcgatcaccatctcctgcgctggaaccagcagtgacgttggtggttataactatgtctcctggtaccaacaatacccaggcaaggcccccaaactcttgatttatgatgtctctaatcggccctccggcgtttctattcgcttctctggctccaagtctggcaacacggcctccctgaccatctctggactccagactgaggacgaggctgattattactgctgctcatatacaggggacagcattatttgggtgttcggcggagggaccaagctgaccgtcctgcgtcagcccaaggctgccccctcggtcact

SEQ ID NO: 587106 - DNA, 489 bp, Homo sapiens; identical to SEQ ID NO: 541604
  misc_feature: HIJSMM301EQAE7.22.86.H09.1.454.light.4.raw

SEQ ID NO: 587107 - DNA, 503 bp, Homo sapiens; identical to SEQ ID NO: 559148
  misc_feature: HIJSMM301DL2DE.7.31.C09.1.454.light.4.raw

SEQ ID NO: 587108 - DNA, 506 bp, Homo sapiens; identical to SEQ ID NO: 554189
  misc_feature: HIJSMM301AONMH.19.78.H01.1.454.light.4.raw

SEQ ID NO: 587109 - DNA, 507 bp, Homo sapiens
  misc_feature: HIJSMM301E2SXV.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcggggccccaggcagatgatgagtgtgattattactgtgtgctctatatgggcagtggcgtttgggtgttcggcggagggaccaagctgaccgttcg

SEQ ID NO: 587110 - DNA, 489 bp, Homo sapiens
  misc_feature: HIJSMM301DZUSI.51.71.G05.1.454.light.4.raw
cgatcgtatacacgaccggtgctcgattagtgtcgtcgcaagagagagggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccca

SEQ ID NO: 587111 - DNA, 486 bp, Homo sapiens
  misc_feature: HIJSMM301EPBHO.41.44.D11.1.454.light.4.raw
tctatactatcacgaccggtgctcgatttagcgcagtacgaagggggctgcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgttcggccaatgcaggcattttagtcatctctggggtccagtttgtggatgaggctgactactattgcacggtctggtacagcagcgctgtggtcttcggcggagggactgaacttatcgtcctaggtcagcccaa

SEQ ID NO: 587112 - DNA, 488 bp, Homo sapiens; identical to SEQ ID NO: 535990
  misc_feature: HIJSMM301CVIIO.11.28.C06.1.454.light.4.raw

SEQ ID NO: 587113 - DNA, 505 bp, Homo sapiens; identical to SEQ ID NO: 536117
  misc_feature: HIJSMM301A1WC4.8.71.G05.1.454.light.4.raw

SEQ ID NO: 587114 - DNA, 479 bp, Homo sapiens; identical to SEQ ID NO: 535188
  misc_feature: HIJSMM301CVONW.10.74.G08.1.454.light.4.raw

SEQ ID NO: 587115 - DNA, 490 bp, Homo sapiens
  misc_feature: HIJSMM301C48I9.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaagggaccaaagtggacatcaagcgaacgtgtggctgcaccatct

SEQ ID NO: 587116 - DNA, 498 bp, Homo sapiens; identical to SEQ ID NO: 537020
  misc_feature: HIJSMM301CHE22.26.26.C04.1.454.light.4.raw

SEQ ID NO: 587117 - DNA, 471 bp, Homo sapiens; identical to SEQ ID NO: 537461
  misc_feature: HIJSMM301B47ED.7.81.H04.1.454.light.4.raw

SEQ ID NO: 587118 - DNA, 505 bp, Homo sapiens; identical to SEQ ID NO: 551816
  misc_feature: HIJSMM301ADBA3.18.78.H01.1.454.light.4.raw

SEQ ID NO: 587119 - DNA, 482 bp, Homo sapiens; identical to SEQ ID NO: 540508
  misc_feature: HIJSMM301EMVQW.43.64.F09.1.454.light.4.raw

SEQ ID NO: 587120 - DNA, 444 bp, Homo sapiens; identical to SEQ ID NO: 535027
  misc_feature: HIJSMM301AR51O.8.73.G07.1.454.light.4.raw

SEQ ID NO: 587121 - DNA, 515 bp, Homo sapiens
  misc_feature: HIJSMM301AJZGY.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtccactctgttcccgccctcctcgagtagtaca

SEQ ID NO: 587122 - DNA, 487 bp, Homo sapiens
  misc_feature: HIJSMM301B4XN8.5.40.D07.1.454.light.4.raw
  modified_base (234)..(234): a, c, t, g, unknown or other
atcagacacgcacgaccggtgctcgatttagtgatagagcgtaacaacagagggtgctcgatttagtgatagagcgtaacaacagaggggggaactgctcagttaggacccagacggaaccatggaagccccagcgcagcttctcttcctcctgctactctggctcccagataccattggagagatagtgatgacgcagtctccagccaccctgtctgtgtctccaggggaaanagccaccctctcctgcagggccagccagagtgtaagtagtaggttagcctggtatcagcagaaacctggccaggctcccaggctcctcatctatggtgcatctaccagggccactggtatcccagccaggttcagtggcagtgggtctgggacagagttcactctcaccatcagcagcctgcagtctgagatttgctagtttatactgtcaacagtataatgactggtgacgttcggccaagggaccaaggta

SEQ ID NO: 587123 - DNA, 497 bp, Homo sapiens
  misc_feature: HIJSMM301CW31O.41.18.B07.1.454.light.4.raw
tctatactatcacgaccggtgctcgatttagtcgctgcgtaagggggggagcctagctgtggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcggggggaccaagctgaccgtcctaggtcagcccaaggctccg

SEQ ID NO: 587124 - DNA, 517 bp, Homo sapiens
  misc_feature: HIJSMM301C1Q7V.27.23.C01.1.454.light.4.raw
agcgtcgtctcacgaccggtgctcgatttagtacacgtgattagggattgggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttgcggaggaccaggctgaccgtcctaggtcagcccaaggctgccccctcggtcactctgttcccaccct

SEQ ID NO: 587125 - DNA, 472 bp, Homo sapiens
  misc_feature: HIJSMM301BZ64B.8.67.G01.1.454.light.4.raw
ctcgcgtgtccacgaccggtgctcgatttagagtatacatattgggtttgggggcttttcctgggctcctgctactctggctccgaggtgccagatgtgacatccagatgacccagtctccatcctccctgtctgcttctataggagacagagtcaccatcacttgccgggcaagtcagaccattagcacctttttaaattggtatcaacagagcccaggaaaagcccccaaactcctgatttatggtgcatccatttcgcaaagtggggtcccatcaaggttcagtggcagtggatctggggcagatttcaccctcaccatcagcagtctgcaacctgaagctttgcaacttactactgtcagcagtcttacagtaggccgggcacctttggccaggggacgaagctggagatcgaacgaactgtggctgcaccatctgtcttcatcttcccgccatctgagacacgcgag

SEQ ID NO: 587126 - DNA, 501 bp, Homo sapiens; identical to SEQ ID NO: 535746
  misc_feature: HIJSMM301DQCIB.18.11.A11.1.454.light.4.raw

SEQ ID NO: 587127 - DNA, 488 bp, Homo sapiens; identical to SEQ ID NO: 535990
  misc_feature: HIJSMM301D3W2T.11.28.C06.1.454.light.4.raw

SEQ ID NO: 587128 - DNA, 490 bp, Homo sapiens; identical to SEQ ID NO: 535234
  misc_feature: HIJSMM301BUK2S.17.21.B10.1.454.light.4.raw

SEQ ID NO: 587129 - DNA, 496 bp, Homo sapiens; identical to SEQ ID NO: 551939
  misc_feature: HIJSMM301AXM5V.19.71.G05.1.454.light.4.raw

SEQ ID NO: 587130 - DNA, 505 bp, Homo sapiens
  misc_feature: HIJSMM301A2QXG.52.36.D03.1.454.light.4.raw
cgcagtacgacacgaccggtgctcgatttagctgcgtcacgatctctcttgggggctgtgggctcaggaggcagagctgtgggtgtctcaccatggcgtgggccacactcctgctcccactcctcaacctctacgcaggctctgttgcctcctatgagctgacacagcttccctcggtgtcagtcgtccccaggacagacagccaggatcacctgctctggagatgtactggggaaaaattatgctgactggtaccagcagaagccaggccaagcccctgagttggtgatatacgaaaatagtgagcgctaccctgggatccctgaccgattctctgggtccacctcagggaagacgaccaccctgaccatcaacagggtccggactgaagacgaggctgactattactgcttgtcgtggggatgaggacacattggtggttcggcggagggaccaagctgaccgtcctacgtcagcccaaggctcgccccctcggtcacttccg

SEQ ID NO: 587131 - DNA, 517 bp, Homo sapiens; identical to SEQ ID NO: 573668
  misc_feature: HIJSMM301DJNMF.43.81.H04.1.454.light.4.raw

SEQ ID NO: 587132 - DNA, 487 bp, Homo sapiens
  misc_feature: HIJSMM301C41VR.26.37.D04.1.454.light.4.raw
agactatactcacgaccggtgctcgatttagtagcatactgttgggtttgggggaggaactgctcagttaggacccagccggaaccatggaagccccagcgcagcttctcttcctcctgctactctggctcccagataccactggagaaatagtgatgacgcagtctccagccaccctgtctgtgtctccaggggaaagagtcaccctctcctgcagggccagtcagagtgttagtcgcggcttagcctggtaccagcagacacctgggcagactcccaggctcctcatttatgctgcatccaccagggccactggtatcccagccaggttcagtggcagtgggtctgggacagagttcactctcaccatcagcagcctgcagtctgaagattgtgcaatttattactgtcagcaatataatacctggcctccgctcactttcggcggagggaccaaggttgagatcaaacgaactgtgctgcacca

SEQ ID NO: 587133 - DNA, 498 bp, Homo sapiens
  misc_feature: HIJSMM301EO2EO.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctgggacagacttcactctcaccatcagcagcctagagcctgaagactttggactttattactgtcagcagcgtgagttctggcctccgctcactttcggcggagggaccaggggtggagatacaaacgaactgtggctgcaccatctgtcttcattccc

SEQ ID NO: 587134 - DNA, 506 bp, Homo sapiens
  misc_feature: HIJSMM301BDBJ8.10.71.G05.1.454.light.4.raw
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagactttcactctcaccatcagcagcctagagcctgaagattttgctagtttattactgtcagcagcgtgccactttcggcggaggtggccactttcggcggagggaccaaaataagaggtacaaacgaaactgtggctgcaccatctgtcttc

SEQ ID NO: 587135 - DNA, 513 bp, Homo sapiens
  misc_feature: HIJSMM301CSZ3T.9.14.B03.1.454.light.4.raw
tgatacgtctcacgaccggtgctcgatttagtgtgagtagttccgcgggggtgggctcaggaggcagagctctgggaatctcaccatggcctggacccctctcctgctccccctcctcactttctgcacagtctctgaggcctcctatgatctgacacagccaccctcggtgtcagtgtccccaggacagacggccaggatcacctgctctggagatggattatcaaaaaaatatgtttattggtaccaacagaagtcaggccaggccccccttctagtcatctatgaggacgccaggcgaccctccgggatccctgagagaatctcgggctccagttcagggacagtggccaccttgacgatcggtggggcccaggtggaagatgaagctgactacttctgttactcaacagacgacagtgcggatcatagagggatgttcggcggagggaccaagctgaccgtctaggtcagcccaaggctgccccctggtcactctgttcccacctcctc

SEQ ID NO: 587136 - DNA, 509 bp, Homo sapiens
  misc_feature: HIJSMM301CDRAF.48.28.C06.1.454.light.4.raw
agtatacatacacgaccggtgctcgatttagagctcacgtattgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtcctaagtcagcccaaggctcgccccctcggtcactctgttcccccg

SEQ ID NO: 587137 - DNA, 497 bp, Homo sapiens; identical to SEQ ID NO: 536807
  misc_feature: HIJSMM301AGFPM.10.37.D04.1.454.light.4.raw

SEQ ID NO: 587138 - DNA, 538 bp, Homo sapiens
  misc_feature: HIJSMM301DM58V.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaaacctggccaggctccccgactcctcttctttggtggagcctacagggccactggcaccccagacaggatcagtggcagcgggtctgggacagacttcattctcaccatcaacagactgcagcctgaagatattgcagtttactaactgtcagcagtatgttacgtcccccgtggacgttcgtccgaacgggaccgaaacggtggcgaatcaaaccgaaactacgtggcgttgcacccaatctgtctttctatctttccccg

SEQ ID NO: 587139 - DNA, 487 bp, Homo sapiens; identical to SEQ ID NO: 536206
  misc_feature: HIJSMM301CKIKQ.47.38.D05.1.454.light.4.raw

SEQ ID NO: 587140 - DNA, 488 bp, Homo sapiens; identical to SEQ ID NO: 535990
  misc_feature: HIJSMM301BEJBF.11.28.C06.1.454.light.4.raw

SEQ ID NO: 587141 - DNA, 488 bp, Homo sapiens; identical to SEQ ID NO: 555597
  misc_feature: HIJSMM301DRJBX.47.38.D05.1.454.light.4.raw

SEQ ID NO: 587142 - DNA, 507 bp, Homo sapiens
  misc_feature: HIJSMM301CUT03.5.58.F03.1.454.light.4.raw
  modified_base (414)..(414): a, c, t, g, unknown or other
atcagacacgcacgaccggtgctcgatttagtctgatcgagaagggaaagggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggttatcagggcaataagcggccctcaggggtttctaatcgcttctctggctccaagtctggcaacacggccgccctgacaatctctgggctccaggctgacgacgaggctgatttttacngctgctcatatgcaggtgatcacacttttatgttcgggactgggaccaaggtcacgtcctaggtcagcccaaggccaacccatgtcactctcg

SEQ ID NO: 587143 - DNA, 508 bp, Homo sapiens
  misc_feature: HIJSMM301CP9I0.9.33.C11.1.454.light.4.raw
tgatacgtctcacgaccggtgctcgatttagagtgagctcgttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgctagtttattactgtcaacatcgtacgagtggcctccggggccacttcggccctgggaccaaaattgagatcaaacgaactagtggctgcaccatctgtcttcatcttcccg

SEQ ID NO: 587144 - DNA, 503 bp, Homo sapiens
  misc_feature: HIJSMM301CXM08.48.38.D05.1.454.light.4.raw
agtatacatacacgaccggtgctcgatttagtatctgatagttgggtttgggggggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgaccaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtctaagtcagcccaaggctcgccccctcggtcactctcgtt

SEQ ID NO: 587145 - DNA, 444 bp, Homo sapiens; identical to SEQ ID NO: 536685
  misc_feature: HIJSMM301BHCIU.10.76.G10.1.454.light.4.raw

SEQ ID NO: 587146 - DNA, 502 bp, Homo sapiens
  misc_feature: HIJSMM301DANVY.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctggaccaaagtggatatcaaacgaactgtggctgcaccatctgt

SEQ ID NO: 587147 - DNA, 494 bp, Homo sapiens
  misc_feature: HIJSMM301C0Y43.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtcctaggtcagcccaaggctcgccccctcggtcactctgttcccacctcctcacgcg

SEQ ID NO: 587148 - DNA, 441 bp, Homo sapiens
  misc_feature: HIJSMM301BJR9L.41.73.G07.1.454.light.4.raw
tctatactatcacgaccggtgctcgatttagctctacgctcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggccccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgccccctcggtcactctgttcccaccctcctcatagtataga

SEQ ID NO: 587149 - DNA, 444 bp, Homo sapiens
  misc_feature: HIJSMM301C797I.17.21.B10.1.454.light.4.raw
cgtagactagcacgaccggtgctcgatttagtgtcgtcgcaagggtgacgggcagggagagtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaactggatatcagacgaactgtggctgcaccatctgtcttcattttcccgccatctgactagtctacg

SEQ ID NO: 587150 - DNA, 480 bp, Homo sapiens
  misc_feature: HIJSMM301A9455.21.25.C03.1.454.light.4.raw
tcgtcgctcgcacgaccggtgctcgatttagtagtgtagatttgggtttgggggctgttcctggaagttgctgataccagtgcacatcaaaaggtgacccgatgttggagctgctcccagcgcaggagatggtgaccgtctgccctggggccccagacaccgagggcggctgcgtcagcacagactgggcccaggaccctgtgcagtgagcgaggagagtgaggaggagaggagaccaggccatgctggagattgtcctgagtgctgcctcttgtgcccacagctgaagcagagcctccaaactcctcatctatggtaacagcaatcggccctcaggggtccctgaccgattctctggctccaagtctggcactcagcctccctggtcatcgctgggctccaggctgacgatgaggctgattattattgccagtcctatgacaacaccctgcgtggttttggctgttcggcggcgggacc

SEQ ID NO: 587151 - DNA, 506 bp, Homo sapiens
  misc_feature: HIJSMM301DLZ1E.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggccaacccctacg

SEQ ID NO: 587152 - DNA, 490 bp, Homo sapiens; identical to SEQ ID NO: 538714
  misc_feature: HIJSMM301BHMGU.11.12.B01.1.454.light.4.raw

SEQ ID NO: 587153 - DNA, 486 bp, Homo sapiens; identical to SEQ ID NO: 558658
  misc_feature: HIJSMM301BFE0C.41.57.F02.1.454.light.4.raw

SEQ ID NO: 587154 - DNA, 493 bp, Homo sapiens
  misc_feature: HIJSMM301C91SR.5.57.F02.1.454.light.4.raw
atcagacacgcacgaccggtgctcgatttagctcgatatagttgggtttggggaggaactgctcagttaggacccagacggaaccatggaagccccagcgcagcttctcttcctcctgctactctggctcccagataccgttggggagatcgtgatgacgcagtctccagccatcctgtctgtgtctccaggggagagagccaccctctcctgcagggccagtcagaacattggtagcaacttagcctggtaccaaacaaaaacctggccagcctcccagactcctcatttatcgttcatccaccagggccactgatgtcccaaccagattcagtggcagagggtctgggacagacttcagtctcaccatcagcagcgtacagtctgaagacttggcagtttattactgtcaacaatgtggtcagtggcctcgaacgttcggcccagggaccacagtggatatcaggcgaactgtggctgcaccatctgtctt

SEQ ID NO: 587155 - DNA, 485 bp, Homo sapiens
  misc_feature: HIJSMM301BFSTB.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcagtcccaagaacttttggccaggggaccaagctggagatcaaacgaactgtggctgcaccat

SEQ ID NO: 587156 - DNA, 485 bp, Homo sapiens; identical to SEQ ID NO: 536576
  misc_feature: HIJSMM301BTYD2.46.35.D02.1.454.light.4.raw

SEQ ID NO: 587157 - DNA, 495 bp, Homo sapiens
  misc_feature: HIJSMM301AHZ7U.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactgacatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttctatcttccccg

SEQ ID NO: 587158 - DNA, 506 bp, Homo sapiens; identical to SEQ ID NO: 535058
  misc_feature: HIJSMM301ENXHE.17.41.D08.1.454.light.4.raw

SEQ ID NO: 587159 - DNA, 484 bp, Homo sapiens
  misc_feature: HIJSMM301B1RLM.16.81.H04.1.454.light.4.raw
tgtactactccacgaccggtgctcgatttagtagtgtagattcgcgggggtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttattattgccaacagtataagagttattcaacttttcggcccttgggaccaatgtggatatcaaacgaactgtggctgcaccatctgtctt

SEQ ID NO: 587160 - DNA, 497 bp, Homo sapiens; identical to SEQ ID NO: 539058
  misc_feature: HIJSMM301DP315.12.87.H10.1.454.light.4.raw

SEQ ID NO: 587161 - DNA, 500 bp, Homo sapiens
  misc_feature: HIJSMM301CXYJ3.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtacacttttggccaggggtccaagctggagatgaaacgactgtggctgcaccatctgtcttcatcttccccg

SEQ ID NO: 587162 - DNA, 495 bp, Homo sapiens; identical to SEQ ID NO: 545183
  misc_feature: HIJSMM301BHCRN.16.10.A10.1.454.light.4.raw

SEQ ID NO: 587163 - DNA, 521 bp, Homo sapiens; identical to SEQ ID NO: 538715
  misc_feature: HIJSMM301DD2P1.27.23.C01.1.454.light.4.raw

SEQ ID NO: 587164 - DNA, 484 bp, Homo sapiens
  misc_feature: HIJSMM301EPAUJ.43.61.F06.1.454.light.4.raw
tgtgagtagtcacgaccggtgctcgatttagctacgctctaagggaaaggggagagctctggagaagagctgctcagttaggacccagagggaaccatggaaaccccagcgcagcttctcttcctcctgctactctggctcccagatgccaccggagcaattgtgttgacgcagtctccaggcaccctgtctttgtctccaggagaaacagccaccctctcctgccgggccagtcagagtgttagagaagactacttagcctggtaccagcaaaaacctggccaggctcccaggctcctcatcaatggtgcatccagtagggccactggcatcccagacaggttcagtggcagtgggtctgcgacagacttcactctcattatcagcagactggagcctgaggactttgcagtgtatttctgtcaacaatatggtagctcaccgtacacttttggccaggggaccaagctagaaatcaaacgaa

SEQ ID NO: 587165 - DNA, 454 bp, Homo sapiens
  misc_feature: HIJSMM301A0Q90.43.34.D01.1.454.light.4.raw
tgtgagtagtcacgaccggtgctcgatttagatcgtctgtgttgggtttgggggctttgcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgatgtcacttatcggccctcaggggtttcttatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggccaaccccactgtcactctgttcccgccctcctcactactcaca

SEQ ID NO: 587166 - DNA, 508 bp, Homo sapiens; identical to SEQ ID NO: 541780
  misc_feature: HIJSMM301CTYH4.17.28.C06.1.454.light.4.raw

SEQ ID NO: 587167 - DNA, 490 bp, Homo sapiens
  misc_feature: HIJSMM301EJEPJ.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgcagtttattactgtcagcagtataataactggcctccggtcactttcggcggagggaccaaggtgggagatcaaacgaactgtggctgcaccat

SEQ ID NO: 587168 - DNA, 504 bp, Homo sapiens
  misc_feature: HIJSMM301CRYNV.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcta

SEQ ID NO: 587169 - DNA, 513 bp, Homo sapiens; identical to SEQ ID NO: 545752
  misc_feature: HIJSMM301A7FVJ.17.33.C11.1.454.light.4.raw

SEQ ID NO: 587170 - DNA, 497 bp, Homo sapiens
  misc_feature: HIJSMM301BK3YX.15.25.C03.1.454.light.4.raw
  modified_base (496)..(496): a, c, t, g, unknown or other
tctacgtagccacgaccggtgctcgatttagtagtgtagatttgggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctccagcatactgatggatacaactatttggattggtacctgcagaagccagggcagtctccacaactcctgatctatttgggttctaatcgggcctccggggtccctgacaggttcagtggcagtggatcaggcatagattttacactgaaaatcagcagagtggaggctgaggacgttggggtttattactgcatgcaaggtctacaaaccccgatccaccttcggccgagggacacgcctggagattaacgaactgtgctgcaccnt

SEQ ID NO: 587171 - DNA, 501 bp, Homo sapiens; identical to SEQ ID NO: 568432
  misc_feature: HIJSMM301AHBH4.2.49.E05.1.454.light.4.raw

SEQ ID NO: 587172 - DNA, 494 bp, Homo sapiens; identical to SEQ ID NO: 534992
  misc_feature: HIJSMM301BJ87Q.9.1.A01.1.454.light.4.raw

SEQ ID NO: 587173 - DNA, 468 bp, Homo sapiens
  misc_feature: HIJSMM301EQRYG.5.28.C06.1.454.light.4.raw
atcagacacgcacgaccggtgctcgatttagagctcacgtattgggtttgggggcaggagtcagtcccaaccaggacacagcatggacatgagggtccctgctcagctcctggggctcctgctgctctggctctcaggtgccagatgtgacatccagatgacccagtctccatcgtccgtgtctgcatctgtaggagacagagtcaccatcacttgtcaggcgagtcaggacattggtaattacttaacttggtatcagcagaaaccagggaaagtccccaaactcctgatctacgatgcatctaatttggaaatagggtctcatcaaggttcagtgggagtggatctgggacagaattcactttcaccatcagcagcctgcaacctgaagatattgcaacatattactgtcaacagtatgatagtctggccgccttcggcggaggaccaaggtggagatcgaacgaa

SEQ ID NO: 587174 - DNA, 498 bp, Homo sapiens
  misc_feature: HIJSMM301D1ZE7.43.83.H06.1.454.light.4.raw
tgtgagtagtcacgaccggtgctcgatttagatcacgtgcgtcgcgggggctgctcagttaggacccagagggaaccatggaaaccccagcgcagcttctcttcctcctgctactctggctcccagataccaccggagaaactgtgttgacgcagtctccaggcacgctgtctttgtctccaggggaaagagccaccctctcgtgtagggccagtcagagtgttatcaccgactccttagcctggtaccagcagaaacctggccaggctcccaggctcctcatatatggtgcatccagcaggatcactggcatcccagcgaggttcagtggccatgggtctgggacggagttcactctcaccatcagccgactggagcctgaagattttgcagtatattactgtcaacaatatggtagttctcctctcactttcggcggagggaccgaaggtggaagtcaaacgaactgtggctgcaccatctgtcttcatcttcccg

SEQ ID NO: 587175 - DNA, 507 bp, Homo sapiens; identical to SEQ ID NO: 561702
  misc_feature: HIJSMM301A6NT3.5.24.C02.1.454.light.4.raw

SEQ ID NO: 587176 - DNA, 354 bp, Homo sapiens; identical to SEQ ID NO: 535026
  misc_feature: HIJSMM301B0AEN.19.22.B11.1.454.light.4.raw

SEQ ID NO: 587177 - DNA, 478 bp, Homo sapiens; identical to SEQ ID NO: 535129
  misc_feature: HIJSMM301D0H7N.11.11.A11.1.454.light.4.raw

SEQ ID NO: 587178 - DNA, 487 bp, Homo sapiens; identical to SEQ ID NO: 536206
  misc_feature: HIJSMM301AHAMX.47.38.D05.1.454.light.4.raw

SEQ ID NO: 587179 - DNA, 489 bp, Homo sapiens; identical to SEQ ID NO: 546040
  misc_feature: HIJSMM301D1I8A.11.12.B01.1.454.light.4.raw

SEQ ID NO: 587180 - DNA, 496 bp, Homo sapiens; identical to SEQ ID NO: 540261
  misc_feature: HIJSMM301CJ4YJ.3.78.H01.1.454.light.4.raw

SEQ ID NO: 587181 - DNA, 512 bp, Homo sapiens
  misc_feature: HIJSMM301BBDDZ.9.12.B01.1.454.light.4.raw
  modified_base (430)..(430): a, c, t, g, unknown or other
tgatacgtctcacgaccggtgctcgatttagtagtgtagattccgcgggggacgaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagttttcncgggtcgttcggccgaagggaccaagggtaggaaagtacaaacgaactagtggcgtgcaccactctgtcttcatcttccccg

SEQ ID NO: 587182 - DNA, 501 bp, Homo sapiens
  misc_feature: HIJSMM301ARRIT.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaacgggaccgaacggtaggaaggtacaaacgaactagtaggctcgcaccatctgtctt

SEQ ID NO: 587183 - DNA, 484 bp, Homo sapiens; identical to SEQ ID NO: 535240
  misc_feature: HIJSMM301CQUM1.47.60.F05.1.454.light.4.raw

SEQ ID NO: 587184 - DNA, 500 bp, Homo sapiens; identical to SEQ ID NO: 539563
  misc_feature: HIJSMM301ATIS1.8.2.A02.1.454.light.4.raw

SEQ ID NO: 587185 - DNA, 490 bp, Homo sapiens; identical to SEQ ID NO: 535234
  misc_feature: HIJSMM301AYAXF.17.21.B10.1.454.light.4.raw

SEQ ID NO: 587186 - DNA, 509 bp, Homo sapiens
  misc_feature: HIJSMM301BOLDM.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaagccaaccccactgtcactctgttcccta

SEQ ID NO: 587187 - DNA, 470 bp, Homo sapiens; identical to SEQ ID NO: 536130
  misc_feature: HIJSMM301C8WJD.7.81.H04.1.454.light.4.raw

SEQ ID NO: 587188 - DNA, 471 bp, Homo sapiens
  misc_feature: HIJSMM301DBQCG.4.79.H02.1.454.light.4.raw
agcactgtagcacgaccggtgctcgatttagtgtcacacgaagggaaaggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctcctcatctctgatgcctccactctgcacggtggcgtcccgccaacgttcagcggcagcggatctgggacagaattcagcctcaccatcagcagcctgcagcctgatgatgttgcaacttactactgtcaacaatataaacagttactggacgttcggccaagggaccaaggtggaactcaaacgaactgtgg

SEQ ID NO: 587189 - DNA, 501 bp, Homo sapiens; identical to SEQ ID NO: 550139
  misc_feature: HIJSMM301BX7PG.15.56.F01.1.454.light.4.raw

SEQ ID NO: 587190 - DNA, 501 bp, Homo sapiens; identical to SEQ ID NO: 536818
  misc_feature: HIJSMM301ERYXL.12.82.H05.1.454.light.4.raw

SEQ ID NO: 587191 - DNA, 479 bp, Homo sapiens; identical to SEQ ID NO: 537141
  misc_feature: HIJSMM301BJ60K.7.76.G10.1.454.light.4.raw

SEQ ID NO: 587192 - DNA, 489 bp, Homo sapiens; identical to SEQ ID NO: 536663
  misc_feature: HIJSMM301EBYXR.16.72.G06.1.454.light.4.raw

SEQ ID NO: 587193 - DNA, 496 bp, Homo sapiens; identical to SEQ ID NO: 535423
  misc_feature: HIJSMM301CDP4Y.3.33.C11.1.454.light.4.raw

SEQ ID NO: 587194 - DNA, 514 bp, Homo sapiens; identical to SEQ ID NO: 546238
  misc_feature: HIJSMM301D5QSQ.47.85.H08.1.454.light.4.raw

SEQ ID NO: 587195 - DNA, 454 bp, Homo sapiens; identical to SEQ ID NO: 536347
  misc_feature: HIJSMM301ATHJD.19.86.H09.1.454.light.4.raw

SEQ ID NO: 587196 - DNA, 521 bp, Homo sapiens; identical to SEQ ID NO: 538715
  misc_feature: HIJSMM301ALDVR.27.23.C01.1.454.light.4.raw

SEQ ID NO: 587197 - DNA, 454 bp, Homo sapiens; identical to SEQ ID NO: 535005
  misc_feature: HIJSMM301EFGUG.19.86.H09.1.454.light.4.raw

SEQ ID NO: 587198 - DNA, 480 bp, Homo sapiens
  misc_feature: HIJSMM301AGCQV.4.33.C11.1.454.light.4.raw
agcactgtagcacgaccggtgctcgatttagagtgagctcgttgggtttgggggagtcagactcagtcaggacacagcatggacatgtgggtccccgctcagctcctggggctcctgctgctctggctcccaggtgccaaatgtgacatccagatgacccagtctccctccaccctgtctgcatctttaggagacagagtcaccatcacctgccgggccagtcaaagtattagtaactcgttggcctggtatcagcaaagaccaggcagagccccaaagctccttatctctgatgcctccaatttgcacagtggggtcccaccaacgttcagcggcagtggatctgggacagagttcactctcaccatcagcagcctgcagcctgacgatgtggcaacttattactgccaacagtatgatagttattggacgttcggccaagggaccaagatagaaatcaaacgaactgtggctgcacca

SEQ ID NO: 587199 - DNA, 501 bp, Homo sapiens; identical to SEQ ID NO: 555551
  misc_feature: HIJSMM301C1OUW.21.81.H04.1.454.light.4.raw

SEQ ID NO: 587200 - DNA, 497 bp, Homo sapiens
  misc_feature: HIJSMM301C1TM9.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccaagctgaccgtcctgggtcagcccaaggctcgccccctcggtcactcc

SEQ ID NO: 587201 - DNA, 494 bp, Homo sapiens; identical to SEQ ID NO: 535828
  misc_feature: HIJSMM301ELRT8.3.36.D03.1.454.light.4.raw

SEQ ID NO: 587202 - DNA, 472 bp, Homo sapiens; identical to SEQ ID NO: 535898
  misc_feature: HIJSMM301A104S.15.8.A08.1.454.light.4.raw

SEQ ID NO: 587203 - DNA, 503 bp, Homo sapiens
  misc_feature: HIJSMM301B2UJN.43.86.H09.1.454.light.4.raw
tgtgagtagtcacgaccggtgctcgatttagtgctatagacttgggtttggggactgatcaggactcctcagttcaccttctcacaatgaggctccctgctcagctcctggggctgctaatgctctgggtcccaggatccggtggggatgttgtgatgactcagtctccactctccctgcccgtcacccttgggcagccggcctccatctcctgcaggtctagtgaaagcctcgtacacgttgatggaaacacctacttgaattggattcagcagaggccaggccaatctccaaggcgcctaatttataaggtttctaaccgggactctggggtcccagacagattcagcggcagtgggtctggcactgatttcacactgacaatcagcagggtggaggctgaggatgttgggttttattacttgcatgcaaacttcacactggcctccgttcacttttggccaggggaccaaggtggagatcaaacgaactgtggctgcacc

SEQ ID NO: 587204 - DNA, 520 bp, Homo sapiens; identical to SEQ ID NO: 539176
  misc_feature: HIJSMM301AO82K.27.23.C01.1.454.light.4.raw

SEQ ID NO: 587205 - DNA, 489 bp, Homo sapiens
  misc_feature: HIJSMM301ER4M7.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaaggtggagatcaaacgaact

SEQ ID NO: 587206 - DNA, 493 bp, Homo sapiens; identical to SEQ ID NO: 536769
  misc_feature: HIJSMM301AH81S.19.83.H06.1.454.light.4.raw

SEQ ID NO: 587207 - DNA, 494 bp, Homo sapiens; identical to SEQ ID NO: 534992
  misc_feature: HIJSMM301EJSVL.9.1.A01.1.454.light.4.raw

SEQ ID NO: 587208 - DNA, 479 bp, Homo sapiens
  misc_feature: HIJSMM301D6EAT.49.27.C05.1.454.light.4.raw
agtcgagagacacgaccggtgctcgatttagacgcgatcgaagggtttgggggagtcagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagatattgcaacatattactgtcaacagtatgatagtctcccgctcactttcggtcggggggaccgaaggtggagatcaagcgaactgtggctg

SEQ ID NO: 587209 - DNA, 503 bp, Homo sapiens; identical to SEQ ID NO: 536313
  misc_feature: HIJSMM301A0RFQ.21.22.B11.1.454.light.4.raw

SEQ ID NO: 587210 - DNA, 490 bp, Homo sapiens; identical to SEQ ID NO: 535064
  misc_feature: HIJSMM301DN2CF.10.72.G06.1.454.light.4.raw

SEQ ID NO: 587211 - DNA, 481 bp, Homo sapiens
  misc_feature: HIJSMM301DRE7Q.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtgtggcccgctcattttcggcggagggaccaagtgcagatcaacgaactgtggctgca

SEQ ID NO: 587212 - DNA, 492 bp, Homo sapiens; identical to SEQ ID NO: 574842
  misc_feature: HIJSMM301DWWZW.10.33.C11.1.454.light.4.raw

SEQ ID NO: 587213 - DNA, 484 bp, Homo sapiens; identical to SEQ ID NO: 536162
  misc_feature: HIJSMM301EF93A.13.59.F04.1.454.light.4.raw

SEQ ID NO: 587214 - DNA, 516 bp, Homo sapiens
  misc_feature: HIJSMM301EPKXI.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacccgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggctgccccctcggtcactctgttcccgcctcctcacg

SEQ ID NO: 587215 - DNA, 490 bp, Homo sapiens
  misc_feature: HIJSMM301DABNA.51.55.E11.1.454.light.4.raw
cgatcgtatacacgaccggtgctcgatttagcactcgcacgttgggtttggggagagctgctcagttaggacccagagggaaccatggaaaccccagcgcagcttctcttcctcctgctactctggctcccagatacctccggtgagattgtgttgacgcagtctccaggcaccctgtctttgtttccaggggacagagccaccctctcctgcagggccagtcagagttttagcagcaactacttggcctggtaccagcagaaacctggccaggctcccaggctcctcatctatggtgcatccagcagggccgctggcatcccagacaggttcagtggcagtgggtctgggacagacttcagtctcaccatcagcggactggagcctgaagattttgcagtgtattactgtcagcaccatggtagctcatcccggtacacttttggccgggggaccaagctggagatcaaacgaactgtggctgcaccat

SEQ ID NO: 587216 - DNA, 505 bp, Homo sapiens
  misc_feature: HIJSMM301ALIGJ.47.83.H06.1.454.light.4.raw
agctcacgtacacgaccggtgctcgatttagatcacgtgcgtcgcgggggaaaaggccctgaggaaaacaaaccccagctgggaagcctgagaacacttagccttcatgagtgtccccaccatggcctggatgatgcttctcctcggactccttggttttgggacaggagtggattctcagactgtggtgacccaggagccatcgttctcagtgtcccgtggagggacagtcacactcacttgtggcttgagctctggctcagtctccactacatactcccccagctggtaccagcagaccccgggccagactccacgcacgctcatctacaacacagacactcgctcttctggggtccctgatcgcttctctggttccatccttgggaacaaagctgccctcaccatcgcgggggcccaggcagatgatgagtgtgattattactgtgtgctctatatgggcagtggcgtttgggtgttcggcggagggaccaagctgaccgtc

SEQ ID NO: 587217 - DNA, 490 bp, Homo sapiens
  misc_feature: HIJSMM301DNV08.40.57.F02.1.454.light.4.raw
  modified_base (432)..(432): a, c, t, g, unknown or other
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagctgaggatgaggctacttattttgctgctcttatgcaggcngtttcgctctcgaatgttcggcggaggccgagctgccgtctcgtcagcccaaggctcg

SEQ ID NO: 587218 - DNA, 461 bp, Homo sapiens
  misc_feature: HIJSMM301EP2UT.49.8.A08.1.454.light.4.raw
agtcgagagacacgaccggtgctcgatttagcatactctacaggggagtcagtcctaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 587219 - DNA, 486 bp, Homo sapiens; identical to SEQ ID NO: 535043
  misc_feature: HIJSMM301EA3OH.46.35.D02.1.454.light.4.raw

SEQ ID NO: 587220 - DNA, 512 bp, Homo sapiens
  misc_feature: HIJSMM301AF1J3.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggacgaacggtaggaagtacaagacgaactagtggcgtgcaccatctgtcttctactcttcccgtcccg

SEQ ID NO: 587221 - DNA, 502 bp, Homo sapiens; identical to SEQ ID NO: 536604
  misc_feature: HIJSMM301A5651.27.78.H01.1.454.light.4.raw

SEQ ID NO: 587222 - DNA, 512 bp, Homo sapiens
  misc_feature: HIJSMM301BP6N0.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaacgggaccgaaaggtggaaagtacaaaacgaactagtggctgcaccatctgtcttctatcttccccg

SEQ ID NO: 587223 - DNA, 498 bp, Homo sapiens; identical to SEQ ID NO: 559536
  misc_feature: HIJSMM301BQBZY.40.57.F02.1.454.light.4.raw

SEQ ID NO: 587224 - DNA, 498 bp, Homo sapiens; identical to SEQ ID NO: 547576
  misc_feature: HIJSMM301BD48X.12.37.D04.1.454.light.4.raw

SEQ ID NO: 587225 - DNA, 477 bp, Homo sapiens; identical to SEQ ID NO: 535122
  misc_feature: HIJSMM301AS0DD.26.72.G06.1.454.light.4.raw

SEQ ID NO: 587226 - DNA, 493 bp, Homo sapiens
  misc_feature: HIJSMM301D6UNL.52.53.E09.1.454.light.4.raw
cgcagtacgacacgaccggtgctcgatttagagagagtgtgttgggtttgggggctgtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaaccctctgt

SEQ ID NO: 587227 - DNA, 503 bp, Homo sapiens; identical to SEQ ID NO: 569972
  misc_feature: HIJSMM301BKTQ0.14.57.F02.1.454.light.4.raw

SEQ ID NO: 587228 - DNA, 520 bp, Homo sapiens
  misc_feature: HIJSMM301BDV67.19.80.H03.1.454.light.4.raw
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggcctgccccctcggtccactctgttcccgccctcctccacg

SEQ ID NO: 587229 - DNA, 491 bp, Homo sapiens; identical to SEQ ID NO: 541413
  misc_feature: HIJSMM301ATPGM.14.28.C06.1.454.light.4.raw

SEQ ID NO: 587230 - DNA, 495 bp, Homo sapiens
  misc_feature: HIJSMM301D4HFK.21.27.C05.1.454.light.4.raw
  modified_base (199)..(199): a, c, t, g, unknown or other
tcgtcgctcgcacgaccggtgctcgatttagacgcgatcgaagggtttgggggaggaactgctcagttaggacccagacggagccatggaagccccagcgcagcttctcttcctcctgcttctctggctcccagacaccactggagtgattgtgatgacgcagtctccagccaccctgtctgtgtctccgaggggggancgccaccctctcctgcacagccagtcagtctatcgctgactggttagcctggtaccagcagaaatctggccaggctcccaggctcctcatttaccgtgcatccaccagggccactggtgtcccagacaggttcagtggcggtggatttgggacagagttttctctcaccatcagcgccctacagagtgaagatgttgctagtttattctgccagcaatataattactggcctgcgtcgacgttcggccacggaccgaaggtggaaatcaaacgaactgtggctgcacatctgtctt

SEQ ID NO: 587231 - DNA, 493 bp, Homo sapiens; identical to SEQ ID NO: 536289
  misc_feature: HIJSMM301CT2VF.14.5.A05.1.454.light.4.raw

SEQ ID NO: 587232 - DNA, 454 bp, Homo sapiens; identical to SEQ ID NO: 536943
  misc_feature: HIJSMM301C6VG1.19.86.H09.1.454.light.4.raw

SEQ ID NO: 587233 - DNA, 503 bp, Homo sapiens; identical to SEQ ID NO: 551625
  misc_feature: HIJSMM301CKSWZ.10.71.G05.1.454.light.4.raw

SEQ ID NO: 587234 - DNA, 508 bp, Homo sapiens; identical to SEQ ID NO: 541396
  misc_feature: HIJSMM301B4JYJ.17.33.C11.1.454.light.4.raw

SEQ ID NO: 587235 - DNA, 502 bp, Homo sapiens
  misc_feature: HIJSMM301EJ2KY.10.43.D10.1.454.light.4.raw
catagtagtgcacgaccggtgctcgatttagactagcagtaagggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctggggacagacttcactctcaccatcatcagcctggagcctgaagatgttgcagtttattactgtcaacatcgtaccgagtggcctccgggggccactttcggccctgggaccaagtggatatcaaacgaactgtggctgcaccatctgtcttcatt

SEQ ID NO: 587236 - DNA, 514 bp, Homo sapiens; identical to SEQ ID NO: 547648
  misc_feature: HIJSMM301D7RF0.16.1.A01.1.454.light.4.raw

SEQ ID NO: 587237 - DNA, 495 bp, Homo sapiens
  misc_feature: HIJSMM301AHITL.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgaactgtggctgcaccatctgtcctt

SEQ ID NO: 587238 - DNA, 485 bp, Homo sapiens
  misc_feature: HIJSMM301BBPCQ.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtgacgttggccaaggaccaaggtggatatcagacgaa

SEQ ID NO: 587239 - DNA, 497 bp, Homo sapiens
  misc_feature: HIJSMM301DF32O.51.5.A05.1.454.light.4.raw
cgatcgtatacacgaccggtgctcgatttagatagatagacagggcacgaccggtgctcgatttagatagatagacagggggctgtgggctcaggaggcagagctctgggaatctcaccatggcctggacccctctcctgctccccctcctcactttctgcacagtctctgaggcctcctatgagctgacgcagccaccctcagtgtcagtgtctccaggacaaacggccaagatcacctgctttggagatgcgttgccaaagaaatctgctttttggtaccatcagaggccaggccaggcccctgtattggtcatctatgaggacaccaagcgaccctccggaatccctgagagagtcgctggctccaggtcagggacaatggccaccttgactatcactgggacccagatggacgatgaaggtgactaccactgttattcgacagacagcagtggtagtcagggggtcttcggcggagggacgaagctgtacccg

SEQ ID NO: 587240 - DNA, 489 bp, Homo sapiens; identical to SEQ ID NO: 543809
  misc_feature: HIJSMM301BAHH6.19.71.G05.1.454.light.4.raw

SEQ ID NO: 587241 - DNA, 496 bp, Homo sapiens
  misc_feature: HIJSMM301DPMZ7.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccgaggggagagagcccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcatcttccccg

SEQ ID NO: 587242 - DNA, 497 bp, Homo sapiens; identical to SEQ ID NO: 536371
  misc_feature: HIJSMM301AL7BI.16.78.H01.1.454.light.4.raw

SEQ ID NO: 587243 - DNA, 505 bp, Homo sapiens; identical to SEQ ID NO: 535503
  misc_feature: HIJSMM301ARONV.8.28.C06.1.454.light.4.raw

SEQ ID NO: 587244 - DNA, 463 bp, Homo sapiens; identical to SEQ ID NO: 535062
  misc_feature: HIJSMM301AVG14.11.73.G07.1.454.light.4.raw

SEQ ID NO: 587245 - DNA, 484 bp, Homo sapiens; identical to SEQ ID NO: 535240
  misc_feature: HIJSMM301BIJQ2.47.60.F05.1.454.light.4.raw

SEQ ID NO: 587246 - DNA, 454 bp, Homo sapiens
  misc_feature: HIJSMM301A07NZ.15.11.A11.1.454.light.4.raw
tctacgtagccacgaccggtgctcgatttagctacgactgcagggtgggtaagaaatacctgcaactgtcagcctcagcagagctctggggagtctgcaccatggcttggaccccactcctcttcctcaccctcctcctccactgcacagggtctctctcccagcttgtgctgactcaatcgccctctgcctctgcctccctgggagcctcggtcaagctcacctgcactctgagcagtgggcacaccagctacgccatcgcatggcatcagcagcagccagagaagggccctcgctacttgatgaagcttaacactgatggcagccacagtaagggggacggatccctgatcgcttctcaggctccagctctggggctgagcgctacctcaccatctccagcctccagtctgaggatgaggctgactattactgtcagacctggggcactggc

SEQ ID NO: 587247 - DNA, 507 bp, Homo sapiens
  misc_feature: HIJSMM301B7JYP.15.59.F04.1.454.light.4.raw
tctacgtagccacgaccggtgctcgatttagtacacacacttagggattggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctccggt

SEQ ID NO: 587248 - DNA, 510 bp, Homo sapiens
  misc_feature: HIJSMM301BL675.52.53.E09.1.454.light.4.raw
cgcagtacgacacgaccggtgctcgatttagagagagtgtgttgggtttggggactgatcaggactcctcagttcaccttctcacaatgaggctccctgctcagctcctggggctgctaatgctctgggtcccagcatccactggggatgttataatgactcagtctccactctccctgcccgtctcccttggacagccggcctccatctcctgcaggtctagtcaaggcctcgttttcagtgatggaaacacctacttgaattggtttcaccagaggccaggccaacctccaaggcgcctaatttataaggtttctaagcgggactctggggtcccagacagattcagcggcagtgggtcaggcactgatttctcactgcaaatcagcggggtgaggctgaggatgttggggtttattactgcatgcaaggtacacactggcctccgacgttcggccaagggaccaaggtggaaatcaaacgaactgtggctgcaccatctgtcttcta

SEQ ID NO: 587249 - DNA, 415 bp, Homo sapiens; identical to SEQ ID NO: 558486
  misc_feature: HIJSMM301DRJA0.18.78.H01.1.454.light.4.raw

SEQ ID NO: 587250 - DNA, 503 bp, Homo sapiens
  misc_feature: HIJSMM301DEIZC.41.35.D02.1.454.light.4.raw
tctatactatcacgaccggtgctcgatttagcacacgatagttgggtttgggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtctaggtcagcccaaggctgccccctcggt

SEQ ID NO: 587251 - DNA, 485 bp, Homo sapiens
  misc_feature: HIJSMM301D7YPG.13.73.G07.1.454.light.4.raw
tcacgtactacacgaccggtgctcgatttagctctacgctcagggggatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacactggccgtacacttttggtccaggggaccgaaagcctggaggatcaatacgaa

SEQ ID NO: 587252 - DNA, 509 bp, Homo sapiens
  misc_feature: HIJSMM301EGF8S.43.67.G01.1.454.light.4.raw
tgtgagtagtcacgaccggtgctcgatttagagtatacatattgggtttgggggagctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccgggtccctgaccgattccgtggcagcgggtctgggacagacttcactctcaccatcagtagcctgcagcctgaagatgtggacaacttattactgtcaactaatttcgttatactccgccgacgttcggccggggaccgaccgtggaaatcaaacgaactgtggctgcaccatctgtctt

SEQ ID NO: 587253 - DNA, 505 bp, Homo sapiens
  misc_feature: HIJSMM301DTVTX.5.60.F05.1.454.light.4.raw
atcagacacgcacgaccggtgctcgatttagtacgtcatcagggaaaggggcagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatctcttgttctggaagcacctccaacatcggaagtaatattgtaaactggtaccagcagctcccaggaacggcccccaaactcctcatctataggaataatcaacggccctcaggggtccctgaccgattctctggctccaagtctggcacctcagcctccctggccatccgtgggctccagtctgaggatgagtctgattattactgtgcaacatgggatgacagcctgaatggtccggtattcggcggagggaccaagctgaccgtctcggtcagccaaggctgccccc

SEQ ID NO: 587254 - DNA, 493 bp, Homo sapiens; identical to SEQ ID NO: 540127
  misc_feature: HIJSMM301EEC2D.10.17.B06.1.454.light.4.raw

SEQ ID NO: 587255 - DNA, 503 bp, Homo sapiens
  misc_feature: HIJSMM301EHY9E.13.38.D05.1.454.light.4.raw
tcacgtactacacgaccggtgctcgatttagtatctgatagttgggtttgggggcaggagtcagacccagtcaggacacagcatggacatgagggtccccgctcagctcctggggctcctgctgctctggctcccaagtgccaaatgtgacatccagatgacccagtctccttccaccctgtctgcgtctgtgggagacagagtcattatcacttgccgggccactcagtttgttggtaggtggttgtcctggtatcagcaaaagccagggcaagcccctaaactcctgatctttgaggcgtctactttagaacgggggatctcacccaggttcagcggcagtggatctgggacagaattcaccctcaccatcaacagcctgcagcctgaagactctgcaacttactactgtcaacagtataatacttattacacttttggccagggggaccaaagtggagatcaaacgaactgtggctgcaccatctgtcttcatcttcccg

SEQ ID NO: 587256 - DNA, 507 bp, Homo sapiens
  misc_feature: HIJSMM301C8OJK.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccatgcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctcgggaccgaaagtaggatatcaaacgaactagtggctgcaccatctgtt

SEQ ID NO: 587257 - DNA, 503 bp, Homo sapiens
  misc_feature: HIJSMM301BG978.40.41.D08.1.454.light.4.raw
tctagcgactcacgaccggtgctcgatttagtcacgcgagaaagggaaagggggagagactgaagaacccagcattgcagcagctccaccatggcctgggctcctctgctcctcaccctcctcagtctcctcacagggtccctctcccagcctgtgctgactcagccaccttctgcatcagcctccctgggagcctcggtcacactcacctgcaccctgagcagcggctacagtaattataaagtggactggtaccagcagagaccagggaagggccccggtttgtgatgcgagtgggcactggtgggattgtgggatccaagggggatggcatccctgatcgcttctcagtcttgggctcaggcctgaatcggtacctgaccatcaagaacatccaggaagaggatgagagtgactaccactgtggggcagaccatggcagtgggagcaacttcgggggtgttcggcggagggaccaagctgaccgtcctaggtcagccccg

SEQ ID NO: 587258 - DNA, 487 bp, Homo sapiens; identical to SEQ ID NO: 542049
  misc_feature: HIJSMM301D9YU4.19.71.G05.1.454.light.4.raw

SEQ ID NO: 587259 - DNA, 486 bp, Homo sapiens; identical to SEQ ID NO: 535043
  misc_feature: HIJSMM301CL89C.46.35.D02.1.454.light.4.raw

SEQ ID NO: 587260 - DNA, 513 bp, Homo sapiens
  misc_feature: HIJSMM301CEFLK.10.80.H03.1.454.light.4.raw
catagtagtgcacgaccggtgctcgatttagctgtgcgtcgaagggaaaggggctgggcctaaggaagcagcactggtggtgcctcagccatggcctggaccgttctcctcctcggcctcctctctcactgcacagcctctgcgacctcctatgtgctgtctcagccaccctcggtgtcagtggccccaggagagacggccaggataacctgtgggggagacagcattgaaagtgaagctgtccactggtaccagcagaggccaggccaggcccctgtactggtcctctatgatgatagtgaccggccctcagggatccctgagcgattctctggctccaactctgggaacacggccaccctgaccatcaccagggtcgaagccggggatgaggccgactattattgtcaggtgtggtatttcagtagtattcatccgggggttttcggcggagggaccaagctgaccgtcctaggtcagcccaaggctgccccctcggtcactctcgttccc

SEQ ID NO: 587261 - DNA, 488 bp, Homo sapiens; identical to SEQ ID NO: 539884
  misc_feature: HIJSMM301D3W3X.7.85.H08.1.454.light.4.raw

SEQ ID NO: 587262 - DNA, 506 bp, Homo sapiens
  misc_feature: HIJSMM301CC6T2.3.79.H02.1.454.light.4.raw
agacgcactccacgaccggtgctcgatttagtgtcacacgaagggaaaggggggggtctcaggaggcagcgctctcgggacgtctccaccatggcctgggctctgctattcctcaccctcctcactcagggcacagagtcctgggcccagtctgccctgactcagcctgcctccgtgtctgggtctcctggacagtcgatcaccatctcctgcactggaaccaacagtgacgttgattttttatatctctgtctcctggtaccaacaacacccaggcaaagcccccaaactcatcatttatgatgtcactgctcggccctcaggggtttctcatcgcttttctggctccaagtctggcaccacggcctccctgacccatctcggggctccaggctgaggacgaggctgcttattactgcagctcatatacaaggagcaccactctcgtggtatttggtgagggaccaagctgaccgtctaggtcagcccaaggctgccccctcggt

SEQ ID NO: 587263 - DNA, 522 bp, Homo sapiens
  misc_feature: HIJSMM301CIXXT.27.23.C01.1.454.light.4.raw
  modified_base (449)..(449): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggaccccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtnttcggcggagggaccaggctgaccgtcctaggtcagcccaaggctgccccctcggtcactctgttcccaccct

SEQ ID NO: 587264 - DNA, 498 bp, Homo sapiens; identical to SEQ ID NO: 577251
  misc_feature: HIJSMM301AKZBC.22.14.B03.1.454.light.4.raw

SEQ ID NO: 587265 - DNA, 445 bp, Homo sapiens; identical to SEQ ID NO: 537719
  misc_feature: HIJSMM301EFR1V.47.85.H08.1.454.light.4.raw

SEQ ID NO: 587266 - DNA, 482 bp, Homo sapiens
  misc_feature: HIJSMM301DNWQ7.48.28.C06.1.454.light.4.raw
agtatacatacacgaccggtgctcgatttagagctcacgtattgggtttggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagaccagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggtagggaccaagctgaccgtcctaagtcagaccccg

SEQ ID NO: 587267 - DNA, 519 bp, Homo sapiens
  misc_feature: HIJSMM301AJNT9.10.38.D05.1.454.light.4.raw
catagtagtgcacgaccggtgctcgatttagtatctgatagttgggtttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgactttgttgcttataactatgtctcctggtaccagcaccacccaggcaaagcccccaaactccttgtttttgaggtcagtaagcggccctcaggagtccctgatcggttctctgcctccaagtctggcaacacggcctccctgaccgtctctgggctccaggctgaggatgaggctgattactactgcagcgcatattcaggccccaacagggtgtttggcggcgggactaaggtgaccgtcctgggtcagcccaaggctgccccctcggtcactctgttcccaccct

SEQ ID NO: 587268 - DNA, 502 bp, Homo sapiens
  misc_feature: HIJSMM301AQ06E.17.10.A10.1.454.light.4.raw
cgtagactagcacgaccggtgctcgatttagcgtcgatctcaggggagctctgcttcagctgtgagcgcagaaggcaggactcgggacaatcttcatcatgacctgctcccctctcctcctcacccttctcattcactgcacagggtcctgggcccagtctgtgttgacacagccgccctcagtgtctgcggcccccggacaggaggtcaccatctcttgctctggaaacccccccaatgttggattcaattatgtgtcctggtaccagcaactcccgggatcagcccccaaactcctcatatatgaagataataagcgaccctcaggggttcctgaccgattctctggctccaagtctggcacgtctgccaccctgggcatcaccgcgctccagactggggacgaggccgagtatttctgcgcaacatgggattccagcctgacttctggggtgttcggcagtgggaccaagctgaccgtcctaggtcagcccaaggctcg

SEQ ID NO: 587269 - DNA, 486 bp, Homo sapiens; identical to SEQ ID NO: 536555
  misc_feature: HIJSMM301C2LR9.26.23.C01.1.454.light.4.raw

SEQ ID NO: 587270 - DNA, 506 bp, Homo sapiens
  misc_feature: HIJSMM301CSXMF.9.31.C09.1.454.light.4.raw
tgatacgtctcacgaccggtgctcgatttagacgtctcatcaaggaaggaaggggggggtctcaggaggcagcgctctcgggacgtctccaccatggcctgggctctgctattcctcaccctcctcactcagggcacagggtcttgggcccagtctgccctgactcagcctgcctccgtgtctgggtctcctggacagtcgatagccatctcctgcactggaactaacagtgacgttggtgcttataattatgtctcctggtatcaacaacacccaggcaaagccccccaactcattatttctgatgtcaacaatcggcccccagggatttctgatcgcttctctggctccaagtctggcaacacggcctccctgaccatctctgggctccgggctgaggacgaggctcactattactgcagctcatatacaaccagcgacactctgttgttcggcggagggactgaactgaccgtcctaggtcagcccaaggctcgccccctggt

SEQ ID NO: 587271 - DNA, 506 bp, Homo sapiens
  misc_feature: HIJSMM301EM056.14.57.F02.1.454.light.4.raw
cgtctagtaccacgaccggtgctcgatttagctcgatatagttgggtttggggggaactgctcagttaggacccagagggaaccatggaagccccagctcagcttctcttcctcctgctactctggctcccagataccaccggagaaattgtgttgacacagtctccactcaccctgtctttgtctccaggggaaagagccaccctctcctgcagggccagtcagagtgtcaacaccaacttagcctggtttcagcagaagcctggccaggctcccaggctcctcatgtatgatgcatcccacagggccaccggcatcccagccaggttcagtggcagcgggtctgggacagacttcactctcaccatcagcagcctagagtctgaagattttgcagtttattactgtcagcagcgggcaattggccgctcacgtttcggtgggggacgtaaggtggagttcgaaacgaactgtggctgcaccatctgtcttcatcttcccgccta

SEQ ID NO: 587272 - DNA, 493 bp, Homo sapiens
  misc_feature: HIJSMM301DCNFN.43.34.D01.1.454.light.4.raw
tgtgagtagtcacgaccggtgctcgatttagatcgtctgtgttgggtttgggggctggggtcacaagaggcagcgctctcgggacgtctccaccatggcctgggctctgctgctcctcactctcctcgctcaggacacagggttcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtctaggtcagcccaagg

SEQ ID NO: 587273 - DNA, 513 bp, Homo sapiens
  misc_feature: HIJSMM301C4CQH.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttccggcccttcgggaccaaacggtggatatcaaacgaactgtggctgcaccatctgtcttcta

SEQ ID NO: 587274 - DNA, 485 bp, Homo sapiens
  misc_feature: HIJSMM301C0ZNI.47.41.D08.1.454.light.4.raw
agctcacgtacacgaccggtgctcgatttagtcacgcgagaaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttactttcaccatcagcagcctgcagcctgaagatattgcaacatattactgtcaacagtatcataatctccccactttcgccctgggaccaaagtggatatcaaacgaactgtggctgcaccatctgtt

SEQ ID NO: 587275 - DNA, 490 bp, Homo sapiens
  misc_feature: HIJSMM301EZBGR.4.52.E08.1.454.light.4.raw
agcactgtagcacgaccggtgctcgatttagtcgagctctcagagagaaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcagctacttagcctggtaccaacagaaacctggccaggctcccaggctcctcatctatgatgcatccgacagggccactggcatcccagccaggttcagtggcagtgggtctgggacagacttcactctcaccatcaccagcctagagcctgaggattttgcagtttattactgtcagcagcgtagcaactggcctctgctcactttcggcggagggaccgaaggtggagatcaaacgaactgtggctgcacca

SEQ ID NO: 587276 - DNA, 484 bp, Homo sapiens
  misc_feature: HIJSMM301DNV87.47.60.F05.1.454.light.4.raw
agctcacgtacacgaccggtgctcgatttagtacgtcatcagggaaagggggaggaactgctcagttaggacccagacggaaccatggaagccccagcgcagcttctcttcctcctgctactctggctcccagataccactggcaaaatagtgctgacgcagtctccagccaccctgtctgcctctccaggggaaagagtcaccatctcctgtcgggccggtcagagtattagcagcaacttagcctggcaccagcagaaacctgggcaggctcccaggctcctcatctttgatgcgtccaccagggccactggtttcccagccaggttcagtggcagtgcgtctgcgacagagttcactctcaccatcaacagcctgcagtctgaagattttgcagtttattactgtcagcagtatcatgactggccgctcaccttcggaccaagggacacgactggagattaaacgaactgtgctgcaccat

SEQ ID NO: 587277 - DNA, 489 bp, Homo sapiens; identical to SEQ ID NO: 535139
  misc_feature: HIJSMM301D6JTR.14.55.E11.1.454.light.4.raw

SEQ ID NO: 587278 - DNA, 495 bp, Homo sapiens; identical to SEQ ID NO: 543094
  misc_feature: HIJSMM301B6U30.22.57.F02.1.454.light.4.raw

SEQ ID NO: 587279 - DNA, 523 bp, Homo sapiens
  misc_feature: HIJSMM301ECUW0.12.71.G05.1.454.light.4.raw
atacgacgtacacgaccggtgctcgatttagtgtcgtcgcaagagagaggggggggtcacaagaggcagcgctctcgggacgcctccaccatggcctgggctctgctgctcctcactctcctcactcaggacacagggtcctgggcccagtctgccctgactcagcctgcctccgtgtctgggtctcctggacagtcgatcaccgtctcctgcactgggaccagtaatgattttggaaattttgacctagtctcctggtaccaacaataccccggcaaagtccccaagttaatcatttatgagggcactaagcggccctcaggagtttctgatcgcttctctggctccaaggctggcgaccgggcctccctgacaatatctgggctccaggctgaggacgaggctcattactactgctgctcatatggaggttatagcacttggtgttcggcggcgggaccaaagtgaccgtcctaagtcagcccaaggctgccccctcggtcactctcgttcccgccctccc

SEQ ID NO: 587280 - DNA, 506 bp, Homo sapiens
  misc_feature: HIJSMM301BV7CT.18.59.F04.1.454.light.4.raw
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaacgcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcacgcccaaggcccaacccca

SEQ ID NO: 587281 - DNA, 504 bp, Homo sapiens
  misc_feature: HIJSMM301AELI7.27.78.H01.1.454.light.4.raw
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcacccttcggccaagggacacgactggagattaaacg

SEQ ID NO: 587282 - DNA, 482 bp, Homo sapiens; identical to SEQ ID NO: 537007
  misc_feature: HIJSMM301A9ZRT.41.34.D01.1.454.light.4.raw

SEQ ID NO: 587283 - DNA, 517 bp, Homo sapiens
  misc_feature: HIJSMM301EHERZ.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggccaaggaccgaacggtacggaagtacaagacgaactagtggcgtgcgaccatctgtcgttctactcttcccgtcccc

SEQ ID NO: 587284 - DNA, 484 bp, Homo sapiens; identical to SEQ ID NO: 544273
  misc_feature: HIJSMM301AH9Y2.53.32.C10.1.454.light.4.raw

SEQ ID NO: 587285 - DNA, 508 bp, Homo sapiens; identical to SEQ ID NO: 561979
  misc_feature: HIJSMM301CM2YU.47.85.H08.1.454.light.4.raw

SEQ ID NO: 587286 - DNA, 508 bp, Homo sapiens; identical to SEQ ID NO: 556056
  misc_feature: HIJSMM301EG788.47.85.H08.1.454.light.4.raw

SEQ ID NO: 587287 - DNA, 497 bp, Homo sapiens
  misc_feature: HIJSMM301BBH0C.16.9.A09.1.454.light.4.raw
tgtactactccacgaccggtgctcgatttagcgagacgcgcaggggctgggcctcaggaagcagcatcggaggtgcctcagccatggcatggatccctctcttcctcggcgtccttgcttactgcacaggatccgtggcctcctatgagttgactcagcttccctcagtgtccgtgtccccgggacagacagccagcatcacctgctctggagataacctgggaagtaaatttactttctggtatcagcggaagccaggccagtcccctgttttggtcatctataaagataggaatcggccctcagacatccctgagcgattctctggctccagctctggaaacacagccactctgaccatcaccgggacccagactatggatgaagctgactattactgtcaggcgtgggacagcggcactgtggttttcggcggagggaccaagctgaccgtcctcggtcagcccaaggctgccccctcggtcactctgttcctg

SEQ ID NO: 587288 - DNA, 494 bp, Homo sapiens
  misc_feature: HIJSMM301DTV25.47.10.A10.1.454.light.4.raw
agctcacgtacacgaccggtgctcgatttagcgtcgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaacagaaaccagggaaagcccctaacctcctcatctctactgcatccactttgcaaagtggggtcccatcaaggttcagcggcagtggatctgggacagatttcactctcactatcagcagcctgcagcctgaagattttggaacttattattgtcaacagggtaacagtttcccgctcaccttcggcggagggaccaaggtggagatgaaaagaactgtggctgcaccatctgtcttcta

SEQ ID NO: 587289 - DNA, 491 bp, Homo sapiens; identical to SEQ ID NO: 542796
  misc_feature: HIJSMM301AT317.19.57.F02.1.454.light.4.raw

SEQ ID NO: 587290 - DNA, 486 bp, Homo sapiens
  misc_feature: HIJSMM301CT59N.52.4.A04.1.454.light.4.raw
cgcagtacgacacgaccggtgctcgatttagagtagtgatcaggggtgggcctcaggaagcagcatcggaggtgcctcagccatggcatggatccctctcttcctcggcgtccttgcttactgcacaggatgtgtggcctcctatgaggtgactcagacaccgtcagtgtccgtctccccacggacagacagccagcatcagctgttctggagataaaataggaggataaatatgtttcctggtatcgccagaagccaggccagtcgcctgtcctggtcatctatcacgataagaagcggccctcagggatccctgagcgattctctggctccaactctgggaacacagccactctgaccatcagcgggacccaggctatggatgaggctgactattactgtcagccgtgggacagaagcactctggtgttcggcggaggggaccagggctggaccgtcctaggtcagcccaaggctgcccccctc

SEQ ID NO: 587291 - DNA, 495 bp, Homo sapiens; identical to SEQ ID NO: 535596
  misc_feature: HIJSMM301BTZQ2.10.79.H02.1.454.light.4.raw

SEQ ID NO: 587292 - DNA, 515 bp, Homo sapiens
  misc_feature: HIJSMM301AZYX2.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgcctacggaccgaacggtacggaagtacaagacgaacgtacgtggcgtgcgaccactctgtcttctactcttcccgt

SEQ ID NO: 587293 - DNA, 496 bp, Homo sapiens
  misc_feature: HIJSMM301ENP1A.18.59.F04.1.454.light.4.raw
tacgagtatgcacgaccggtgctcgatttagtacacacacttagggattgggggctggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattatactgcagctcatatacaagcaccagcactctctatgtcttcggaactgggaccaaggtcaccgtcctaggtcagcccaagg

SEQ ID NO: 587294 - DNA, 477 bp, Homo sapiens
  misc_feature: HIJSMM301B65P9.8.85.H08.1.454.light.4.raw
ctcgcgtgtccacgaccggtgctcgatttagtatcactcagtcgcgggggagtcagtctcagtcaggacacagcatggacatgagggtccccgctcagctcctggggctcctgctactctggctccgaggtgccagatgtgacatccagatgacccagtctccatcctccctgtctgcatctgtcggagacagagtcaccatcacttgtcgggcaagtcagactataaataattatttaaattggtatcagcagaaaccagggaacgcccctaagctcctcatatattctgcattcactttgcaaagtggggtcccatcaaggttcagtggcagtggatctgggacagatttcactctcaccatccgcagtctgcaacctgaagattttgcaatttattactgtcaagagactcacaatggaagcacttttggccaggggaccaaggctggagaggaacgaactgtggctgcaccat

SEQ ID NO: 587295 - DNA, 494 bp, Homo sapiens; identical to SEQ ID NO: 540645
  misc_feature: HIJSMM301CPTX0.13.38.D05.1.454.light.4.raw

SEQ ID NO: 587296 - DNA, 557 bp, Homo sapiens
  misc_feature: HIJSMM301D118U.22.5.A05.1.454.light.4.raw
acatacgcgtcacgaccggtgctcgatttagatagatagacagggggaggaactgctcagttaggacccagagggaaccatggaagccccagctcagcttctcttcctcctgctactctggctcccagaaaccaccggagaagttgtgttgacacagtctccagccaccctgtctttgtctccaggggaaagagccaccctctcctgcagggccagtcagagtgttaactactacttagcctggtaccaacagaaacctggccaggctcccaggctcctcatctatgatgcatcttacagggccactggcatcccagccaggttcagtggcagtgggtctgggacagacttcactctcaccatcagcagcctagagcctgaagattttgcagtttattactgtcagcgagcgtagacctaaccttccctaccgtaccggttcgggaccggggaacgggaacccggtaagggtagggaagtactaaccgaaaaccgtaacgtggtcggcgtcgccaacctatctcgttccttactacttcccttccccgactacttcg

SEQ ID NO: 587297 - DNA, 517 bp, Homo sapiens
  misc_feature: HIJSMM301C47A8.41.25.C03.1.454.light.4.raw
tctatactatcacgaccggtgctcgatttagtagtgtagatttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtcctaggtcagcccaaggctgccccctcggtcactctgttccc

SEQ ID NO: 587298 - DNA, 502 bp, Homo sapiens
  misc_feature: HIJSMM301DVS8R.12.85.H08.1.454.light.4.raw
atacgacgtacacgaccggtgctcgatttagtatcactcagttcggtcgggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcacctctttgtcttcggaagtgggaccaaggtcaccgtcctacgtcagcccaaggccaacccca

SEQ ID NO: 587299 - DNA, 488 bp, Homo sapiens
  misc_feature: HIJSMM301C5V90.47.55.E11.1.454.light.4.raw
agctcacgtacacgaccggtgctcgatttagcactcgcacgttgggtttggggagagagacccctcccctgggatcctgcagctccaggctcccgtgggtggggttagagttgggaacctatgaacattctgtaggggccactgtcttctccacggtcaccatctcttgttctggaagcagctccaatatcggaaatgataatgtatactggtaccagcaagtcccacgaacggccccaaactcctcatctataacaatgatcagcggccctcaggggtccctggccgattctctggctccaagtctggcgcctcagccaccctggccatcagtgggctccggcccgaggatgaggctgattattactgtgtaggttgggatcgcagcctgactgcttacgtcttcggagctgggccaaggtcaccgtcctaggtcagcccaaggccaacccactgtcactctgttcccaccctcctctacgtgagct

SEQ ID NO: 587300 - DNA, 488 bp, Homo sapiens; identical to SEQ ID NO: 542699
  misc_feature: HIJSMM301C9BHH.12.51.E07.1.454.light.4.raw

SEQ ID NO: 587301 - DNA, 495 bp, Homo sapiens; identical to SEQ ID NO: 535596
  misc_feature: HIJSMM301ATATK.10.79.H02.1.454.light.4.raw

SEQ ID NO: 587302 - DNA, 501 bp, Homo sapiens
  misc_feature: HIJSMM301CADAK.26.80.H03.1.454.light.4.raw
agactatactcacgaccggtgctcgatttagctgtgcgtcgaagggaaagggactgactaccacctgcaggtcagggccaaggttatggggtcccaggttcacctcctcagcttcctcctcctttggatctctgagccgacactcacgcagtctccagcattcatgtcagcgactctaggagacaaggtcaacttctcctccaaagccagccaagacattgatgatgatatgaactggcaccaacacaaaccaggagaagctgctatttccattactcaagaaactaatggtctcctacctggaatgccacctcgactcagtggcaacaaatatggaacagtttttaccctcacaactcatatcacagaatctgaggatgctgcattttacttcggtctacaacatgataatttccctccgtggacgttgccaagggaccaaggagcaaatacaaacgaactagtggctgcaccaatctgtcttcactcttcccgccatct

SEQ ID NO: 587303 - DNA, 497 bp, Homo sapiens
  misc_feature: HIJSMM301BZHIO.9.53.E09.1.454.light.4.raw
tgatacgtctcacgaccggtgctcgatttagagagagtgtgttgggtttgggggctggggtcacaagaggcagcgctctcgggacgtctccaccatggcctgggctctgctgctcctcaccctcctcactcaggacacacgggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaatcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggagggaccaaggtgaccgtcctaggtcagcccaagg

SEQ ID NO: 587304 - DNA, 447 bp, Homo sapiens; identical to SEQ ID NO: 535201
  misc_feature: HIJSMM301D7JRY.18.9.A09.1.454.light.4.raw

SEQ ID NO: 587305 - DNA, 495 bp, Homo sapiens; identical to SEQ ID NO: 535596
  misc_feature: HIJSMM301BUE1I.10.79.H02.1.454.light.4.raw

SEQ ID NO: 587306 - DNA, 447 bp, Homo sapiens; identical to SEQ ID NO: 535020
  misc_feature: HIJSMM301B96XD.18.9.A09.1.454.light.4.raw

SEQ ID NO: 587307 - DNA, 519 bp, Homo sapiens
  misc_feature: HIJSMM301D0V8H.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtctaggtcagcccaaggctgccccctcggtcactctgttcccgcct

SEQ ID NO: 587308 - DNA, 491 bp, Homo sapiens
  misc_feature: HIJSMM301DN3CL.14.36.D03.1.454.light.4.raw
cgtctagtaccacgaccggtgctcgatttagctgcgtcacgatctctcttggggggggtctcaggaggcagctctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagcagtgacgttggtggttataagtatgtctcctggtaccaacaacacccaggcaaagcccccaaactcatgatttatgaggtcagtaatcggccctcaggggtttctaatcgcttctctggctccaagtctggcaacacggcctccctgaccatctctgggctccaggctgaggacgagtctgattattattgcagctcatatgcacctggcagcaatcatgtggttttcggcggggggaccaaggtgaccgtcctaggtcagccc

SEQ ID NO: 587309 - DNA, 489 bp, Homo sapiens; identical to SEQ ID NO: 542296
  misc_feature: HIJSMM301BV8EX.17.21.B10.1.454.light.4.raw

SEQ ID NO: 587310 - DNA, 502 bp, Homo sapiens
  misc_feature: HIJSMM301BABHB.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggccggagggaccaaggtggagatcaaacgaactgtggctgcaccatctgttcttcatcttcccgccatctgaccta

SEQ ID NO: 587311 - DNA, 488 bp, Homo sapiens; identical to SEQ ID NO: 537124
  misc_feature: HIJSMM301BQSP8.11.25.C03.1.454.light.4.raw

SEQ ID NO: 587312 - DNA, 517 bp, Homo sapiens
  misc_feature: HIJSMM301CDYKB.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccacggaccgaacggtacggaaagtacaagacgaacgtacgtggcgttcgcgaccaactcctgttcttctactt

SEQ ID NO: 587313 - DNA, 489 bp, Homo sapiens
  misc_feature: HIJSMM301BJLGR.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcacctgctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaagctgaccgtcctacgtcacgcccaaggctcgcccccg

SEQ ID NO: 587314 - DNA, 485 bp, Homo sapiens
  misc_feature: HIJSMM301AVL0V.52.53.E09.1.454.light.4.raw
cgcagtacgacacgaccggtgctcgatttagagagagtgtgttgggtttggggagagctctggggagtctgcaccatggcttggaccccactcctcttcctcaccctcctcctccactgcacagggtctctctcccagcctgtgctgactcaatcgccctctgcctctgcctccctgggagcctcggtcaagctcacctgcactctgagcagtgggcactacacctacgccatcgcatggcatcagctgcagccagagaagggccctcggtacttgatgaggctcaacagtgatggcagccacagcaggggggacgtatccctgatcgcttctcaggctccggctctgggactgagcgctacctcaccatctccagcctccagtctgaggacgagggtgactattactgtcagacgtgggacactggcatttgggtgttcggcggagggaccaaagttgaccgtcctaggtcagcccaaggctcg

SEQ ID NO: 587315 - DNA, 481 bp, Homo sapiens
  misc_feature: HIJSMM301DGCO2.48.28.C06.1.454.light.4.raw
agtatacatacacgaccggtgctcgatttagagctcacgtattgggtttggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgagactgactattactgtcaggcgtgggacatcagcagtgaggtggttttcggcggagggaccaagctgaccgtcctaagtcagcccaaggccg

SEQ ID NO: 587316 - DNA, 516 bp, Homo sapiens
  misc_feature: HIJSMM301AV9Y2.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtcctaagtcagcccaaggctcgccccctcggtcactctgttcccaccctcctcg

SEQ ID NO: 587317 - DNA, 517 bp, Homo sapiens
  misc_feature: HIJSMM301ECG7S.41.19.B08.1.454.light.4.raw
tctatactatcacgaccggtgctcgatttagtgagtcagtaagggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccaggtcatcgtcctaggtcagcccaaggccaacccactgtcactctgttcccaccctcctcat

SEQ ID NO: 587318 - DNA, 498 bp, Homo sapiens
  misc_feature: HIJSMM301DP14A.52.36.D03.1.454.light.4.raw
cgcagtacgacacgaccggtgctcgatttagctgcgtcacgatctctcttgggggtgggctcaggaggcagagctgtgggtgtctcaccatggcgtgggccacactcctgctcccactcctcaacctctacgcaggctctgttgcctcctatgagctgacacagcttccctcggtgtcagtgtccccaggacagacagccaggatcacctgctctggagatgtactagggaaaattatgctgactggtaccagcagaagccaggccaagcccctgagttggtgatatacgaaaatagtgagcgctaccctgggatccctgaccgattctctgggtccacctcagggaagacgaccaccctgaccaatcaacagggtccggactgaagacgaggctgactattactgcttgtctggggatgaggacacattggtgttcggcggagggaccaagctgaccgtcctacgtcagccaaggctgccccctcggtcactctgtt

SEQ ID NO: 587319 - DNA, 476 bp, Homo sapiens
  misc_feature: HIJSMM301DO3KO.40.10.A10.1.454.light.4.raw
tctagcgactcacgaccggtgctcgatttagcgtcgatctcagggggagtcagacccactcaggacacagcatggacatgagggtccccgctcagctcctggggctcctgctgctctggctcccaggtgccagatgtgtcatccagatgacccagtctccatcctccctgtctgtatctgttggagacaaagtcaccatcacttgccgcgcaagtcaggacattagaagtgagttgggctggtatcagcagaaaccagggaaagcccctaagctcctgatctatgctgcatccactttgcaaaatggggtcccatcgagattcagcggcagtggatctggcacagagttcactctcaccatcagcaccctgcagcctgaagattttgcgacttatttctgtctacaagattctaattaccctcggacgttcggccaggggaccgaaagtaggatgtctaaccgaactagtggctgc

SEQ ID NO: 587320 - DNA, 444 bp, Homo sapiens; identical to SEQ ID NO: 535042
  misc_feature: HIJSMM301CENUE.10.76.G10.1.454.light.4.raw

SEQ ID NO: 587321 - DNA, 488 bp, Homo sapiens
  misc_feature: HIJSMM301B8LYE.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgctacttattactgtcagcagagttaccgcgctccccatcactttcggccaaggacacgaccgcagattggacgaactgtggctgcacc

SEQ ID NO: 587322 - DNA, 506 bp, Homo sapiens
  misc_feature: HIJSMM301CBWHQ.41.35.D02.1.454.light.4.raw
tctatactatcacgaccggtgctcgatttagcacacgatagttgggtttggggggggtcgacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcgggaggacgaggctgattactacttgcttctcatatgcagatactaagtcctgggtgttcggcgggaggaccaagctgaccgtcctaggtcagcccaaggctgccccctcggt

SEQ ID NO: 587323 - DNA, 494 bp, Homo sapiens; identical to SEQ ID NO: 534992
  misc_feature: HIJSMM301DHIHW.9.1.A01.1.454.light.4.raw

SEQ ID NO: 587324 - DNA, 507 bp, Homo sapiens
  misc_feature: HIJSMM301DIOH0.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccaggataacctgtgtgggaaccagcatcggaggtaaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagccaaggccaacccactgtcactctgttcccg

SEQ ID NO: 587325 - DNA, 354 bp, Homo sapiens; identical to SEQ ID NO: 540485
  misc_feature: HIJSMM301AH5EL.40.9.A09.1.454.light.4.raw

SEQ ID NO: 587326 - DNA, 504 bp, Homo sapiens; identical to SEQ ID NO: 554247
  misc_feature: HIJSMM301DGHLY.19.78.H01.1.454.light.4.raw

SEQ ID NO: 587327 - DNA, 489 bp, Homo sapiens; identical to SEQ ID NO: 535386
  misc_feature: HIJSMM301CR4HF.12.51.E07.1.454.light.4.raw

SEQ ID NO: 587328 - DNA, 490 bp, Homo sapiens
  misc_feature: HIJSMM301DF1JI.49.23.C01.1.454.light.4.raw
agtcgagagacacgaccggtgctcgatttagtacacgtgattagggattgggggtgggctcaggaggcagagctctgggaatctcaccatggcctggacccctctcctgctccccctcctcactttctgcacagtctctgaggcctcctatgagctgacacagtcaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtactttatgtcttcggaactgcgaccaaggtcaccgtcctggtcagcccaaggccaaccccact

SEQ ID NO: 587329 - DNA, 503 bp, Homo sapiens; identical to SEQ ID NO: 540136
  misc_feature: HIJSMM301B8LW8.19.10.A10.1.454.light.4.raw

SEQ ID NO: 587330 - DNA, 485 bp, Homo sapiens; identical to SEQ ID NO: 536040
  misc_feature: HIJSMM301ETKKY.15.1.A01.1.454.light.4.raw

SEQ ID NO: 587331 - DNA, 516 bp, Homo sapiens
  misc_feature: HIJSMM301BZEGN.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggccgtccggggccactttccggcccgtcgggaccaaacgtggagtatacaaacgaactgtggcgtgcaccatctgttcttcta

SEQ ID NO: 587332 - DNA, 505 bp, Homo sapiens; identical to SEQ ID NO: 546412
  misc_feature: HIJSMM301B1JZA.22.21.B10.1.454.light.4.raw

SEQ ID NO: 587333 - DNA, 472 bp, Homo sapiens; identical to SEQ ID NO: 536302
  misc_feature: HIJSMM301CLBQF.18.76.G10.1.454.light.4.raw

SEQ ID NO: 587334 - DNA, 496 bp, Homo sapiens
  misc_feature: HIJSMM301BLQKY.52.71.G05.1.454.light.4.raw
cgcagtacgacacgaccggtgctcgatttagtgtcgtcgcaagagagaggggggaaaaggccctgaggagaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtggcttgagctctggctcagtctctcctaatttctaccccagctggtaccagcagacccccaggccaggctccacgcacgctcatctacagcacaattactcgctcttctggggtccctgatcgcttctctggctccatccttgggaacaagctgccctaaccatcacggggcccaggcagatgatgaatctgattattactgtgtcctctatatgggtagtggcatttggatgttcggcggaggaacc

SEQ ID NO: 587335 - DNA, 497 bp, Homo sapiens; identical to SEQ ID NO: 539718
  misc_feature: HIJSMM301AEVHH.40.54.E10.1.454.light.4.raw

SEQ ID NO: 587336 - DNA, 490 bp, Homo sapiens; identical to SEQ ID NO: 535234
  misc_feature: HIJSMM301ADC9D.17.21.B10.1.454.light.4.raw

SEQ ID NO: 587337 - DNA, 493 bp, Homo sapiens; identical to SEQ ID NO: 535745
  misc_feature: HIJSMM301C8BQ3.47.78.H01.1.454.light.4.raw

SEQ ID NO: 587338 - DNA, 493 bp, Homo sapiens
  misc_feature: HIJSMM301BJ0NY.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactggtggcgtgacaccatctgtcttcta

SEQ ID NO: 587339 - DNA, 505 bp, Homo sapiens; identical to SEQ ID NO: 535503
  misc_feature: HIJSMM301AH2GN.8.28.C06.1.454.light.4.raw

SEQ ID NO: 587340 - DNA, 489 bp, Homo sapiens
  misc_feature: HIJSMM301DK9S0.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggtattttgcaacttactactgtcagcaggctaacaggctcgcccccaaccttcggccaggggaccacgactggagattaaacgaactgtggctgcaccatctgtt

SEQ ID NO: 587341 - DNA, 495 bp, Homo sapiens; identical to SEQ ID NO: 535596
  misc_feature: HIJSMM301BF1PW.10.79.H02.1.454.light.4.raw

SEQ ID NO: 587342 - DNA, 495 bp, Homo sapiens; identical to SEQ ID NO: 554198
  misc_feature: HIJSMM301APQYE.41.53.E09.1.454.light.4.raw

SEQ ID NO: 587343 - DNA, 493 bp, Homo sapiens
  misc_feature: HIJSMM301DEXV1.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactacttacctcaagtgatcaccttcggccaagggacacgactggagattaaacgaactgtggctgcaccatctgtt

SEQ ID NO: 587344 - DNA, 503 bp, Homo sapiens
  misc_feature: HIJSMM301ETAVV.27.78.H01.1.454.light.4.raw
  modified_base (445)..(445): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagngtactactttacctcaagtgatcaccttcggccaagggacacgactggagattaaacg

SEQ ID NO: 587345 - DNA, 492 bp, Homo sapiens; identical to SEQ ID NO: 535126
  misc_feature: HIJSMM301CC7VG.18.11.A11.1.454.light.4.raw

SEQ ID NO: 587346 - DNA, 447 bp, Homo sapiens; identical to SEQ ID NO: 535020
  misc_feature: HIJSMM301DFGC7.18.9.A09.1.454.light.4.raw

SEQ ID NO: 587347 - DNA, 506 bp, Homo sapiens; identical to SEQ ID NO: 535058
  misc_feature: HIJSMM301DAX7C.17.41.D08.1.454.light.4.raw

SEQ ID NO: 587348 - DNA, 490 bp, Homo sapiens; identical to SEQ ID NO: 535234
  misc_feature: HIJSMM301EJUG0.17.21.B10.1.454.light.4.raw

SEQ ID NO: 587349 - DNA, 501 bp, Homo sapiens
  misc_feature: HIJSMM301C6MB8.48.72.G06.1.454.light.4.raw
agtatacatacacgaccggtgctcgatttagctacgactgcaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaagggacacgactggagattaaacgaactgtggctgcaccatctgtcttcatcttccccg

SEQ ID NO: 587350 - DNA, 507 bp, Homo sapiens; identical to SEQ ID NO: 578078
  misc_feature: HIJSMM301APNHQ.18.37.D04.1.454.light.4.raw

SEQ ID NO: 587351 - DNA, 504 bp, Homo sapiens
  misc_feature: HIJSMM301AJGDI.7.5.A05.1.454.light.4.raw
cgtgtctctacacgaccggtgctcgatttagatagatagacaggggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttctagggtttccgtaatcgcttctctggctccaagtctggcgacacggcctccctcgaccatctctgggctccaggctgaagacgaggctgattattactgcagctcatatacaaggcagcagcacttcaggttttcgggcggagggaccaagctgaccgtcctaggtcagcccaaggctgccccctcggt

SEQ ID NO: 587352 - DNA, 478 bp, Homo sapiens
  misc_feature: HIJSMM301ANBQY.5.12.B01.1.454.light.4.raw
atcagacacgcacgaccggtgctcgatttagtagtgtagattccgcgggggcccactgttagggctcaggggctgtgtccaccatggcctggactcttctccttctcgtgctcctctctcactgcacaggttccctctcccagcctgtgctgactcagccatcttcccattctgcatcttctggagcatcagtcagactcacctgcatgctgagcagtggcttcagtgttggggacttctggataaggatatcagaggctgattgcagagtcaccttatagatcacttcatagacacagggaacagaagacacagacaactgaggaagcaaagtttaaattctactcacgtttgatttccaccttggtcccttggccgaacgtcctcgggtgttcggcggagggaccaagctgaccgtcctaggtcagccaaggctgccccctcggtcactctgttcccgccctcctccgtgtctgat

SEQ ID NO: 587353 - DNA, 497 bp, Homo sapiens; identical to SEQ ID NO: 546748
  misc_feature: HIJSMM301EDW2K.43.37.D04.1.454.light.4.raw

SEQ ID NO: 587354 - DNA, 516 bp, Homo sapiens
  misc_feature: HIJSMM301B1CBD.41.73.G07.1.454.light.4.raw
tctatactatcacgaccggtgctcgatttagctctacgctcagggcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcacg

SEQ ID NO: 587355 - DNA, 495 bp, Homo sapiens; identical to SEQ ID NO: 537415
  misc_feature: HIJSMM301EA2MV.4.27.C05.1.454.light.4.raw

SEQ ID NO: 587356 - DNA, 492 bp, Homo sapiens
  misc_feature: HIJSMM301CKRCR.16.68.G02.1.454.light.4.raw
tgtactactccacgaccggtgctcgatttagtcgatagtgaaggggaagggggagtcagacccagtcaggacacagcatggacatgagggtccccgctcagctcctggggctcctgctgctctggctcccaggtgccagatgtgacatccagatgacccagtctccttccaccctgtctgcatctgtaggagacagagtcaccatcacttgccgggccagtcagaatattaataggtggttggcctggtatcagcagaaaccagggaaagcccctaaggtcctgatatatgagacttctactttagaaagtggggtcccatcaaggttcagcggcagtggatctgggacagaattcactctcactatcaccagcctgcaacctgatgattttgcaacttattactgccaacagtatcatcatcattgtaatttcggttggagggaccaaggtggaggtcaaacgaactgtggctgcaccatctgtcttcatt

SEQ ID NO: 587357 - DNA, 501 bp, Homo sapiens
  misc_feature: HIJSMM301B0T95.48.27.C05.1.454.light.4.raw
agtatacatacacgaccggtgctcgatttagacgcgatcgaagggtttggggggggtcgacaagaggcagcgctctcgggacgtctccaccatggcctgggctctgctgctgttcatcctcctcactcaggacacagggtcctgggcccagtctgccctgactcagcctgcctccatgtctgggtctcctagacagtcgatcaccgtctcctgcactggaaccagcagtgatgttgggcgttatgaccttgtctcctggtaccaacaacacccaggcaaagcccccaaactcttgatttatgagatcactaagcggccctcaggcgtttctaatcgcttctctggctccaagtctggcaacacggcctccctgacaatctctgggctccaggctgaggacgaggctgattattattgctgctcatatgcaggtggtactacttgggtgttcggcagagggaccaagctgaccgtcctaggtcagcccaaggctgccccctc

SEQ ID NO: 587358 - DNA, 494 bp, Homo sapiens
  misc_feature: HIJSMM301DNAU5.8.81.H04.1.454.light.4.raw
ctcgcgtgtccacgaccggtgctcgatttagtagtgtagattcgcgggggagtcagacccagtcaggacacagcatggacatgagggtccccgctcagctcctggggctcctgctgctctggctcccaggtgccaactgtgacatccagatgacccagtcaccttccaccctgtctgcatctgtgggagacagagtcaccatcagttgccgggccagtcacagtattgacaatttgttggcctggtatcagcagaaaccaggaaaagccccgaacctcctgatctatcaggcgtctactttggaaagtggggtcccatcaaggttccgcggcagtggatctgggacagacttcactctcaccatcagcagcctgcagcctgatgattttgctacttattactgccaacagtatagtactttttctccggacacttttggccgggggtaccaagctggagatcaaacgaactgtggctgcaccatctgtcttcta

SEQ ID NO: 587359 - DNA, 416 bp, Homo sapiens; identical to SEQ ID NO: 545902
  misc_feature: HIJSMM301AFRIR.18.78.H01.1.454.light.4.raw

SEQ ID NO: 587360 - DNA, 505 bp, Homo sapiens; identical to SEQ ID NO: 555214
  misc_feature: HIJSMM301EYZVZ.19.78.H01.1.454.light.4.raw

SEQ ID NO: 587361 - DNA, 491 bp, Homo sapiens; identical to SEQ ID NO: 535294
  misc_feature: HIJSMM301AY0GL.16.68.G02.1.454.light.4.raw

SEQ ID NO: 587362 - DNA, 495 bp, Homo sapiens; identical to SEQ ID NO: 535596
  misc_feature: HIJSMM301CAVXR.10.79.H02.1.454.light.4.raw

SEQ ID NO: 587363 - DNA, 517 bp, Homo sapiens; identical to SEQ ID NO: 541047
  misc_feature: HIJSMM301DK6AJ.49.10.A10.1.454.light.4.raw

SEQ ID NO: 587364 - DNA, 505 bp, Homo sapiens; identical to SEQ ID NO: 536117
  misc_feature: HIJSMM301BZCA4.8.71.G05.1.454.light.4.raw

SEQ ID NO: 587365 - DNA, 522 bp, Homo sapiens
  misc_feature: HIJSMM301C1LF0.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagccaaggcctgccccctcggtcactctcgttcccgccct

SEQ ID NO: 587366 - DNA, 506 bp, Homo sapiens; identical to SEQ ID NO: 535058
  misc_feature: HIJSMM301CNR3D.17.41.D08.1.454.light.4.raw

SEQ ID NO: 587367 - DNA, 457 bp, Homo sapiens
  misc_feature: HIJSMM301BHWVT.4.76.G10.1.454.light.4.raw
  modified_base (449)..(449): a, c, t, g, unknown or other
agcactgtagcacgaccggtgctcgatttagtcactcatacaggggggagtcagactcagtcaggacacagcatggacatgagggtccccgctcagctcctggggctcctgctgctctggctcccaggtgccaaatgtgacatccagctgacccagtctccctccaccctgtctgcatctataggagacagagtcaccatcacttgccgggccagtcagagtattagtaactggttggcctggtatcagcagaaaccaggcaaagccccaaagctccttatctctgatgcctccactttgcacggtggcgtcccaccaacgttcagcggcagtggatctgggacagaattcactctcaccatcagcagcctgcagcctgatgatgttgcaacttattactgtcaacaatataacaattatgacgtgcaggacaagtgaatcaacaactntgctgcac

SEQ ID NO: 587368 - DNA, 485 bp, Homo sapiens; identical to SEQ ID NO: 540285
  misc_feature: HIJSMM301ADH67.46.26.C04.1.454.light.4.raw

SEQ ID NO: 587369 - DNA, 488 bp, Homo sapiens; identical to SEQ ID NO: 535081
  misc_feature: HIJSMM301CT6OS.26.23.C01.1.454.light.4.raw

SEQ ID NO: 587370 - DNA, 518 bp, Homo sapiens
  misc_feature: HIJSMM301A4RVL.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcggtccaaggaccgaacggtaggaagtacgaaacgaactacgtggctggcaccactctcgtcttctactcttcccgtcccact

SEQ ID NO: 587371 - DNA, 516 bp, Homo sapiens
  misc_feature: HIJSMM301D7C89.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactatttttgtcacgtgtggcacgttagtcatcacgtcttcggaactgggaccacggtcaccgtcctaagtcagcccaaggccaaccccactgtcactctgttcccaccctcctcagtcg

SEQ ID NO: 587372 - DNA, 464 bp, Homo sapiens; identical to SEQ ID NO: 539492
  misc_feature: HIJSMM301EHXJ3.18.59.F04.1.454.light.4.raw

SEQ ID NO: 587373 - DNA, 495 bp, Homo sapiens; identical to SEQ ID NO: 535007
  misc_feature: HIJSMM301DJDA6.22.5.A05.1.454.light.4.raw

SEQ ID NO: 587374 - DNA, 477 bp, Homo sapiens; identical to SEQ ID NO: 541557
  misc_feature: HIJSMM301C7Z55.51.44.D11.1.454.light.4.raw

SEQ ID NO: 587375 - DNA, 480 bp, Homo sapiens; identical to SEQ ID NO: 555208
  misc_feature: HIJSMM301D64Y6.21.25.C03.1.454.light.4.raw

SEQ ID NO: 587376 - DNA, 517 bp, Homo sapiens; identical to SEQ ID NO: 541955
  misc_feature: HIJSMM301D02O1.22.30.C08.1.454.light.4.raw

SEQ ID NO: 587377 - DNA, 478 bp, Homo sapiens; identical to SEQ ID NO: 535129
  misc_feature: HIJSMM301AH4LN.11.11.A11.1.454.light.4.raw

SEQ ID NO: 587378 - DNA, 497 bp, Homo sapiens; identical to SEQ ID NO: 535286
  misc_feature: HIJSMM301A31FM.18.59.F04.1.454.light.4.raw

SEQ ID NO: 587379 - DNA, 515 bp, Homo sapiens; identical to SEQ ID NO: 536247
  misc_feature: HIJSMM301BZFSB.14.19.B08.1.454.light.4.raw

SEQ ID NO: 587380 - DNA, 494 bp, Homo sapiens; identical to SEQ ID NO: 535828
  misc_feature: HIJSMM301CHM74.3.36.D03.1.454.light.4.raw

SEQ ID NO: 587381 - DNA, 487 bp, Homo sapiens
  misc_feature: HIJSMM301EP58W.15.28.C06.1.454.light.4.raw
tctacgtagccacgaccggtgctcgatttagagctcacgtattgggtttgggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattcc

SEQ ID NO: 587382 - DNA, 496 bp, Homo sapiens
  misc_feature: HIJSMM301ALSYB.7.59.F04.1.454.light.4.raw
cgtgtctctacacgaccggtgctcgatttagtacacacacttagggattgggggagtcagacccagtcaggacacagcatggacatgagggtccccgctcagctcctggggctcctgctgctctggctcccaggtgccaaatgtgacatccagatgacccagtctccttccaccctgtctgcatctgtaggagacacagtcaccgtcacttgccgggccagtcagagtattagtaactcgttggcctggtatcagcagaaaccagggaaagcccctaagctcctgatctataaggcgtctagtttagagagtggggtcccatcaaggttcagcggcagtgaaactgggacagaattcattctcaccatcagcagcctgcagcctgatgattttgcaacttattactgccaacagtataagagttatccgtggacgttcggccaagggaccgaggtggaaatcaaacgaactagtggctgcaccatctgtcttcatt

SEQ ID NO: 587383 - DNA, 484 bp, Homo sapiens
  misc_feature: HIJSMM301EITIU.4.27.C05.1.454.light.4.raw
agcactgtagcacgaccggtgctcgatttagacgcgatcgaagggtttgggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcgtcctacatagtaatggatacaactatttggattggtacctgcagaagccagggcagtctccacagctcctgatctatttgggttctaatcgggcctccggggtccctgacaggttcagtggcagtggatcaggcacagattttacactgagaatcagcagagtggaggctgaggatgttggggtttactactgcatgcaagctctacaagccacctacacttttggccaggggaccaggctggagatcaaacgaact

SEQ ID NO: 587384 - DNA, 498 bp, Homo sapiens; identical to SEQ ID NO: 586194
  misc_feature: HIJSMM301AMX6J.10.37.D04.1.454.light.4.raw

SEQ ID NO: 587385 - DNA, 501 bp, Homo sapiens
  misc_feature: HIJSMM301AMG5B.41.42.D09.1.454.light.4.raw
tctatactatcacgaccggtgctcgatttagacacatacgcagggaaagggggaggaactgctcagttaggacccagacggaaccatggaagccccagcgcagcttctcttcctcctgctactctggctcccagatgtcactggagaaatagtgatgacgcagtctccagccaccctgtctgtgtctccaggggaaagagccaccctctcctgcagggccagtcagagtcttagcggcaccttagcctggtaccagcagaaacctggccaggctcccaggctcctcatctatggtacatccaccagggtcactggtgttccagccaggttcagtggcagtgggtccgggacagagttcactctcaccatcagcagcctgcagtctgaagattttgcgatttattactgtcaccactataataattggccctccgcgtggacgttcggccagggaccaaggtggaaatcaaacgaactagtggctgcaccatctgtcttcta

SEQ ID NO: 587386 - DNA, 496 bp, Homo sapiens; identical to SEQ ID NO: 535109
  misc_feature: HIJSMM301AWTFP.16.78.H01.1.454.light.4.raw

SEQ ID NO: 587387 - DNA, 521 bp, Homo sapiens
  misc_feature: HIJSMM301BGCJ3.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggctccctgaccatctccgggctccagcctgaggacgaggctgattattattgtagttcatatacaaccagtgacacttgggtgttcggcggagggaccaggctgaccgtcctaggtcagcccaaggctcgccccctcggtcactctgttcccgccct

SEQ ID NO: 587388 - DNA, 482 bp, Homo sapiens; identical to SEQ ID NO: 540521
  misc_feature: HIJSMM301AJW0T.21.25.C03.1.454.light.4.raw

SEQ ID NO: 587389 - DNA, 505 bp, Homo sapiens; identical to SEQ ID NO: 535987
  misc_feature: HIJSMM301DV600.18.37.D04.1.454.light.4.raw

SEQ ID NO: 587390 - DNA, 484 bp, Homo sapiens
  misc_feature: HIJSMM301CNTKJ.14.53.E09.1.454.light.4.raw
cgtctagtaccacgaccggtgctcgatttagagagagtgtgttgggtttgggggggagcctagctgtgctgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggaggaccaagctgaccgtcta

SEQ ID NO: 587391 - DNA, 447 bp, Homo sapiens; identical to SEQ ID NO: 535201
  misc_feature: HIJSMM301EL77Q.18.9.A09.1.454.light.4.raw

SEQ ID NO: 587392 - DNA, 485 bp, Homo sapiens; identical to SEQ ID NO: 536263
  misc_feature: HIJSMM301EFQCT.47.78.H01.1.454.light.4.raw

SEQ ID NO: 587393 - DNA, 494 bp, Homo sapiens; identical to SEQ ID NO: 539894
  misc_feature: HIJSMM301CRWLU.16.53.E09.1.454.light.4.raw

SEQ ID NO: 587394 - DNA, 454 bp, Homo sapiens; identical to SEQ ID NO: 536325
  misc_feature: HIJSMM301CSRK2.19.86.H09.1.454.light.4.raw
  modified_base (436)..(436): a, c, t, g, unknown or other

SEQ ID NO: 587395 - DNA, 492 bp, Homo sapiens; identical to SEQ ID NO: 538644
  misc_feature: HIJSMM301DRBX5.26.78.H01.1.454.light.4.raw

SEQ ID NO: 587396 - DNA, 480 bp, Homo sapiens
  misc_feature: HIJSMM301BTG8I.13.59.F04.1.454.light.4.raw
tcacgtactacacgaccggtgctcgatttagtacacacacttagggattgggggcagaagtctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaagggtgcagatcaaacgaactgtgg

SEQ ID NO: 587397 - DNA, 515 bp, Homo sapiens; identical to SEQ ID NO: 557200
  misc_feature: HIJSMM301EIHUN.14.70.G04.1.454.light.4.raw

SEQ ID NO: 587398 - DNA, 485 bp, Homo sapiens
  misc_feature: HIJSMM301AYLEK.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggaggggaccaaggtggagatcaaacgaa

SEQ ID NO: 587399 - DNA, 492 bp, Homo sapiens
  misc_feature: HIJSMM301DAKHW.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggccgaagggaccgaaggtggaagtcaaacgaactgtggctgcacatctgtctt

SEQ ID NO: 587400 - DNA, 490 bp, Homo sapiens
  misc_feature: HIJSMM301ADAUN.43.33.C11.1.454.light.4.raw
tgtgagtagtcacgaccggtgctcgatttagagtgagctcgttggggtttggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggtcgagtcggcccattgacgactgtttggcctggtatcgcgtgagaccagggcaacctcctcaacttctgatataccgttcatcgctgttgcacgttggggtcccactcggttcagtggcaacggctctgagacagtatttttctctcgtcatcactggtctacagtctgacgacggcgcaatgtacttctgtcaacactatgcctctcccccctacaatttcggtcaggggaccaagttgaacatcaatcgaactgtggctcgcaccat

SEQ ID NO: 587401 - DNA, 492 bp, Homo sapiens; identical to SEQ ID NO: 536010
  misc_feature: HIJSMM301A8XDJ.10.20.B09.1.454.light.4.raw

SEQ ID NO: 587402 - DNA, 485 bp, Homo sapiens; identical to SEQ ID NO: 539423
  misc_feature: HIJSMM301C15O4.46.35.D02.1.454.light.4.raw

SEQ ID NO: 587403 - DNA, 503 bp, Homo sapiens; identical to SEQ ID NO: 536002
  misc_feature: HIJSMM301BDDFQ.51.23.C01.1.454.light.4.raw

SEQ ID NO: 587404 - DNA, 494 bp, Homo sapiens
  misc_feature: HIJSMM301C4TI7.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagtttattactgtcagcaatattttcgtgctccgtacacttttggccaggggcccaggtggagatcagacgaactgtggctgcaccatctgtcttcatcttcccg

SEQ ID NO: 587405 - DNA, 444 bp, Homo sapiens
  misc_feature: HIJSMM301BX1VD.8.11.A11.1.454.light.4.raw
  modified_base (426)..(426): a, c, t, g, unknown or other
ctcgcgtgtccacgaccggtgctcgatttagctacgactgcagggtcctgggcccagtccgtgctgacgcagccgccctcagtgtctggggccccaggccagagggtcgccatctcctgcactgggaacaactccaacatcggggcaggtcatgatgtacattggtaccagcagtttccaggaaaagcccccggactcctcatttttgttaacaacgatcgcccctcaggggtccctgaccgcttctctggctccaggtctggcgcctctgcctccctggccatcgctgggctccaccttgacgatgagggtttttattactgccagtcgtacgacgacagtctgactgccccggtgttcggcggcgggaccaaggtgaccgtcctgagtcagcccaaggctgcccccacggtcactctgttcccnccctccctcacacgcgag

SEQ ID NO: 587406 - DNA, 502 bp, Homo sapiens
  misc_feature: HIJSMM301CXTWG.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggggttatcaccttgtctcctggtaccaacaccaccccggcagacgcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccaaggctcgcccctcggcact

SEQ ID NO: 587407 - DNA, 514 bp, Homo sapiens; identical to SEQ ID NO: 567443
  misc_feature: HIJSMM301AH30U.14.78.H01.1.454.light.4.raw

SEQ ID NO: 587408 - DNA, 493 bp, Homo sapiens; identical to SEQ ID NO: 540127
  misc_feature: HIJSMM301CHWHS.10.17.B06.1.454.light.4.raw

SEQ ID NO: 587409 - DNA, 524 bp, Homo sapiens; identical to SEQ ID NO: 539528
  misc_feature: HIJSMM301DV61D.49.9.A09.1.454.light.4.raw

SEQ ID NO: 587410 - DNA, 507 bp, Homo sapiens; identical to SEQ ID NO: 538702
  misc_feature: HIJSMM301DQQSY.11.57.F02.1.454.light.4.raw

SEQ ID NO: 587411 - DNA, 488 bp, Homo sapiens
  misc_feature: HIJSMM301DMYGK.43.79.H02.1.454.light.4.raw
tgtgagtagtcacgaccggtgctcgatttagtgtcacacgaagggaaagggggatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccccaggcggagggaccaaggtggagatcaaacgaactgtggctgcacc

SEQ ID NO: 587412 - DNA, 495 bp, Homo sapiens
  misc_feature: HIJSMM301DECTW.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagacgccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacacttttggccaggggaccaagctggagatcaaacgaactgtggctgcaccatct

SEQ ID NO: 587413 - DNA, 496 bp, Homo sapiens
  misc_feature: HIJSMM301BYHIG.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacaggatcctgggctcagtctgccctgactcagccccgctcagtgtccgggtctcctgggcagtcagtcaccatcccctgcactggaaccagcaatgatgttggtcgttataagtatgtctcatggtaccggcagaacccaggcaaagccccccaagtcgttctctatgatgtcactaagcggccctcaggagtccctgatcgattctctggctccaagtctggcaacacggcctcctgaacatctctgggctccaggctgaggatgaggctgattattattgctgctcatatggaagtacctactcttttctctttcggaactgggaccacggtcaccgtcctaggtcagcccaaggcccaaccca

SEQ ID NO: 587414 - DNA, 494 bp, Homo sapiens
  misc_feature: HIJSMM301AQQFB.47.82.H05.1.454.light.4.raw
agctcacgtacacgaccggtgctcgatttagtcgagctctctcgcggggggggtgccgcagccatggcctggaccgctctccttctgagcctccttgctcactttacagtttctgtggcctcctttgacctgactcagccactctcagtgtccgtggccctgggacagacggccagacttacctgtgggggaatcaacattggacgtaaaaatgtgcactggtaccaacagaagccaggccaggcccctgtcctggtcatctataaggatacaaaccggccctctgggatccctgaacgattctctggctccaattcggacaacacggccaccctgaccatcagcagagcccaagtcggagatgaggctgactatttctgtcaaatttgggacatctccgctgcggtattcggcgcagggaccaagctgaccgtcctaagtcagccaaggctgccccctcggtcactctgttcccaccctcctctacgtgagct

SEQ ID NO: 587415 - DNA, 503 bp, Homo sapiens
  misc_feature: HIJSMM301DAD92.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcaggaggacgagggctgactattactgtcaatcaacagacagtagtggtacttatgtgcagttcggcggagggaccaagctgaccgtctaggtcagcccaaggctcgccccctcggtcactcg

SEQ ID NO: 587416 - DNA, 480 bp, Homo sapiens; identical to SEQ ID NO: 547848
  misc_feature: HIJSMM301EN3Y2.7.83.H06.1.454.light.4.raw

SEQ ID NO: 587417 - DNA, 480 bp, Homo sapiens; identical to SEQ ID NO: 551179
  misc_feature: HIJSMM301DGVDJ.10.1.A01.1.454.light.4.raw

SEQ ID NO: 587418 - DNA, 489 bp, Homo sapiens
  misc_feature: HIJSMM301DRI6V.5.47.E03.1.454.light.4.raw
atcagacacgcacgaccggtgctcgatttagactcgcgcacagagagaagggggaagagctgctcagttaggacccagagggaaccatggaaaccccagcgcagcatctcttcctcctgctactctggctcccagataccgccggagaaattgtgttgacgcagtctccaggcaccctgtctttgtctccaggagaaagagccaccctctcctgcagggccagtcagagtgttagcggcgactacttagcctggtaccagcagaaacctggccagactcccaggctcctcatctttggtgtatccagcagggccactggcatcccacgtaggttcagtggcagtgggtctgggacagacttcactctcaccatcagcagactggagcctgaagattttgcagtgtattactgtcagcagtatgggctctcaccttttcactttcggcggagggaccaaggtggagacaaacgaactgtggctgcaccat

SEQ ID NO: 587419 - DNA, 480 bp, Homo sapiens; identical to SEQ ID NO: 559070
  misc_feature: HIJSMM301BNNE4.21.25.C03.1.454.light.4.raw

SEQ ID NO: 587420 - DNA, 478 bp, Homo sapiens
  misc_feature: HIJSMM301BODPL.51.34.D01.1.454.light.4.raw
cgatcgtatacacgaccggtgctcgatttagatcgtctgtgttgggtttggggagtctctctcagtcaggacacagcatggacatgagggtccctgctcagctcctgggactcctgctgctctggctcccagataccagatgtgacatccagatgacccagtctccatcctccctgtctgcatctataggagacagagtcaccatcacttgccgggcgagtcagggcgtcagcatttatttggcctggtatcagcagagaccagggaaagcccctaacctcctgatctatgatgcatccaatttggaaagtggggtcccatcaaggttcagtggcagtggatctgggacagatttcactctcaccatcagcagtgtgcgacctgaagattttgcaacttactactgtcaacagagttacagtacccctcagctcactttcggcggagggaccgaaggtggagatcaaacgaactgtgg

SEQ ID NO: 587421 - DNA, 493 bp, Homo sapiens
  misc_feature: HIJSMM301ALTTY.51.85.H08.1.454.light.4.raw
cgatcgtatacacgaccggtgctcgatttagtatcactcagtcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgcgaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactc

SEQ ID NO: 587422 - DNA, 512 bp, Homo sapiens
  misc_feature: HIJSMM301EFZY4.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattagtagatcaaacgaaactagtggctgcaccatctgtcttctatcttcccgccact

SEQ ID NO: 587423 - DNA, 494 bp, Homo sapiens; identical to SEQ ID NO: 535680
  misc_feature: HIJSMM301BYA6G.16.78.H01.1.454.light.4.raw

SEQ ID NO: 587424 - DNA, 486 bp, Homo sapiens; identical to SEQ ID NO: 535458
  misc_feature: HIJSMM301C79A3.7.75.G09.1.454.light.4.raw

SEQ ID NO: 587425 - DNA, 501 bp, Homo sapiens; identical to SEQ ID NO: 535746
  misc_feature: HIJSMM301BNAP2.18.11.A11.1.454.light.4.raw

SEQ ID NO: 587426 - DNA, 480 bp, Homo sapiens
  misc_feature: HIJSMM301DVNKP.41.60.F05.1.454.light.4.raw
tctatactatcacgaccggtgctcgatttagtacgtcatcagggaaagggggatcaggactcctcagttcaccttctcacaatgaggctccctgctcagctcctggggctgctaatgctctgggtctctggatccagtggggatattgtgatgactcagtctccactctccctgtccgtcagccctggagagccggcctccatctcctgcaggtctagtcagagcctcctgtattctaatggatacagtaatttgaattggtacgtgcggaagccagggcagtctccacagctcctgatatattgggcttctcatcgggcctccggggtccctgacaggttcagtggcagtgggtcaggcacagattttactctgcacatcagcagagtggaggctgaggatgctgcgacttatactgcatgcaacctctacaaactgtgtggacgttcggccaggggaccagggtggaaatcaagcgaa

SEQ ID NO: 587427 - DNA, 464 bp, Homo sapiens
  misc_feature: HIJSMM301DL8NH.18.59.F04.1.454.light.4.raw
tacgagtatgcacgaccggtgctcgatttagtacacacacttagggattgggggctttgcctgggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagtccaaggccaaccccactgtcactctgttcccaccctcctccatactcgta

SEQ ID NO: 587428 - DNA, 491 bp, Homo sapiens; identical to SEQ ID NO: 535194
  misc_feature: HIJSMM301BV1NL.26.78.H01.1.454.light.4.raw

SEQ ID NO: 587429 - DNA, 520 bp, Homo sapiens
  misc_feature: HIJSMM301EQMGF.9.38.D05.1.454.light.4.raw
tgatacgtctcacgaccggtgctcgatttagtatctgatagttgggtttgggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagccccaaactcttgctttatgatgtcagttatcggccctcaggagtttctgatcgcttctctggctccaagtctggcaccacggcctccctgaccatctctgggctccaggctgaggacgaggctgattattctgcagctcaaaagaagtagccctctcgtggttttcggcgggggaccaaggtgaccgtcctaagtcagcccaaggctgccccctcggtcactctgttcccaccctcctcacg

SEQ ID NO: 587430 - DNA, 493 bp, Homo sapiens; identical to SEQ ID NO: 584045
  misc_feature: HIJSMM301BX8G7.26.78.H01.1.454.light.4.raw

SEQ ID NO: 587431 - DNA, 484 bp, Homo sapiens; identical to SEQ ID NO: 535400
  misc_feature: HIJSMM301C8RP5.46.26.C04.1.454.light.4.raw

SEQ ID NO: 587432 - DNA, 522 bp, Homo sapiens
  misc_feature: HIJSMM301C79HH.7.71.G05.1.454.light.4.raw
cgtgtctctacacgaccggtgctcgatttagtgtcgtcgcaagagagagggggagaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccacggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtcggccgtcccgggggccaccgttttcggcccgttcgggacccgtaaaggtagggatatacaaacgaactagtggctgcaccatctgtt

SEQ ID NO: 587433 - DNA, 493 bp, Homo sapiens; identical to SEQ ID NO: 536769
  misc_feature: HIJSMM301B8DLB.19.83.H06.1.454.light.4.raw

SEQ ID NO: 587434 - DNA, 512 bp, Homo sapiens
  misc_feature: HIJSMM301CT04O.47.85.H08.1.454.light.4.raw
agctcacgtacacgaccggtgctcgatttagtatcactcagtcgcgggggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggcaaagcccccaaactcataatttatgacgtcaatgttcgcccctcaggggtttctcatcgcttctctggctccaaatctggcaacacggcctccctgaccatctctgggctcgagtctgaggacgaggctgattacttctgttgctcttgggcactactgtcgtttgggtgttcggcggagggaccgaagttgaccgtcctaggtcagcccaaggctgccccctcgtcactctgttccccg

SEQ ID NO: 587435 - DNA, 507 bp, Homo sapiens; identical to SEQ ID NO: 561702
  misc_feature: HIJSMM301AZIPM.5.24.C02.1.454.light.4.raw

SEQ ID NO: 587436 - DNA, 479 bp, Homo sapiens; identical to SEQ ID NO: 535188
  misc_feature: HIJSMM301CHEQA.10.74.G08.1.454.light.4.raw

SEQ ID NO: 587437 - DNA, 500 bp, Homo sapiens; identical to SEQ ID NO: 542309
  misc_feature: HIJSMM301BZJXD.12.86.H09.1.454.light.4.raw

SEQ ID NO: 587438 - DNA, 502 bp, Homo sapiens; identical to SEQ ID NO: 546060
  misc_feature: HIJSMM301BS706.19.67.G01.1.454.light.4.raw

SEQ ID NO: 587439 - DNA, 510 bp, Homo sapiens
  misc_feature: HIJSMM301DQWZJ.15.86.H09.1.454.light.4.raw
tctacgtagccacgaccggtgctcgatttagtgctatagacttgggtttgggggacttccctggtctccttctacctactgcccttcatttcttccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaagacggttgggtgttcggcggagggaccaagctgaccgtcctaggtcagcccaaggctgccccctcggtcactctgttcccgccctcctcgctacgt

SEQ ID NO: 587440 - DNA, 491 bp, Homo sapiens; identical to SEQ ID NO: 535176
  misc_feature: HIJSMM301AYEUZ.13.39.D06.1.454.light.4.raw

SEQ ID NO: 587441 - DNA, 517 bp, Homo sapiens; identical to SEQ ID NO: 564566
  misc_feature: HIJSMM301DL6T0.14.66.F11.1.454.light.4.raw

SEQ ID NO: 587442 - DNA, 497 bp, Homo sapiens
  misc_feature: HIJSMM301EAF3Q.14.64.F09.1.454.light.4.raw
cgtctagtaccacgaccggtgctcgatttagcgcgtatacaagggggagtcagtctcagtcaggacacagcatggacatgagggtccccgctcagctcctggggctcctgctactctggctccgaggtgccagatgtgacacccagttgacccagtctccatcctccctgtctgcatctgtaggagacagagtcaccatcacttgccggacaagtcagagcgttatcgcctatttaaattggtatcagcaaaaaccagggaaagcccctaacctcctgatctttgatgcatccaatttgcagagtggggtcccatcacgcttcactggcagtggctctgggacagatttcactctcaccatcagcggtctccaacctgaagattttgcaacttactactgtcaacagagttatgataccccgtggacgttcggccgagggaccgaaggtggaggatacaaacgaactgtggctgcaccatctgtcttcatcttcccg

SEQ ID NO: 587443 - DNA, 510 bp, Homo sapiens
  misc_feature: HIJSMM301CQJC2.51.27.C05.1.454.light.4.raw
cgatcgtatacacgaccggtgctcgatttagacgcgatcgaagggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataattatgtctcctggtaccaacaccacccaggcaaagcccccaaactcatgatttatgatgtcagtgatcggccctcaggggtttcgaatcgcttctctggctccaagtccggcaacacggcctccctgaccatctctgggctccaggccgaggacgaggctgattattactgcacctcatatacaagcagcaacaattgggtgttcggcggagggaccaagctgaccgtctaggtcagccaaggctgccccctcggtcactctgtt

SEQ ID NO: 587444 - DNA, 483 bp, Homo sapiens
  misc_feature: HIJSMM301C4KUE.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgacttggtctcgatcaccttcggccaagggacacgactggagattaaacgaactgtggctgcacatct

SEQ ID NO: 587445 - DNA, 503 bp, Homo sapiens
  misc_feature: HIJSMM301A5AEF.40.26.C04.1.454.light.4.raw
tctagcgactcacgaccggtgctcgatttagtctagcgactttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcactcccagacaggttcagtggcagtgggtctgggacagacttcactctcaccgtcagcagactggaccctgaagattttgcagtgtattactgtcagcagtatggtagctcaccgatcaccttcggccaagggacacgactggagataaccgaactgtggctgcaccatctgtcttcatcttcccg

SEQ ID NO: 587446 - DNA, 501 bp, Homo sapiens; identical to SEQ ID NO: 535873
  misc_feature: HIJSMM301CJM6Q.17.27.C05.1.454.light.4.raw

SEQ ID NO: 587447 - DNA, 521 bp, Homo sapiens
  misc_feature: HIJSMM301BVV3Q.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggaccccagaccctggacgcctccagttggaagcagccgatccagcctgccggagcctgtgggcaggtcagcccaaggccaaccccactgtcactctcg

SEQ ID NO: 587448 - DNA, 487 bp, Homo sapiens
  misc_feature: HIJSMM301CTPE4.49.83.H06.1.454.light.4.raw
agtcgagagacacgaccggtgctcgatttagatcacgtgcgtcgcggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagaatattaataagtggttggcctggtatcagcagataccagggaaagcccctaaactcctgatctatgaggcgtctagtttagaaagtggggtcccttcaaggttcagcggcagtggatctgggacagaattcactctcaccaccaacagcctgcagcctgatgattttgcaacttattactgccaacactataatcattattctccggccactttcggccctgggaccaggctagatatcggacgaactgtggctgcaccatctgtt

SEQ ID NO: 587449 - DNA, 495 bp, Homo sapiens; identical to SEQ ID NO: 537415
  misc_feature: HIJSMM301E1RE2.4.27.C05.1.454.light.4.raw

SEQ ID NO: 587450 - DNA, 508 bp, Homo sapiens; identical to SEQ ID NO: 540739
  misc_feature: HIJSMM301AW350.14.7.A07.1.454.light.4.raw

SEQ ID NO: 587451 - DNA, 513 bp, Homo sapiens; identical to SEQ ID NO: 547639
  misc_feature: HIJSMM301BWPB7.43.59.F04.1.454.light.4.raw

SEQ ID NO: 587452 - DNA, 506 bp, Homo sapiens
  misc_feature: HIJSMM301C00PO.11.57.F02.1.454.light.4.raw
  modified_base (475)..(475): a, c, t, g, unknown or other
cgagagataccacgaccggtgctcgatttagctcgatatagttgggtttgggggaggaactgctcagttaggacccagagggaaccatggaagccccagctcagcttctcttcctcctgctacactggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagtattttgcagtttattactgtcaacagcgtagcagcaggcctccggcgacgttcggccaaggaccaaggtggaagtcagcgaacngtgctgcaccatctgtcttcatcttcccgcc

SEQ ID NO: 587453 - DNA, 484 bp, Homo sapiens; identical to SEQ ID NO: 535211
  misc_feature: HIJSMM301BGXAH.47.46.E02.1.454.light.4.raw

SEQ ID NO: 587454 - DNA, 519 bp, Homo sapiens; identical to SEQ ID NO: 550353
  misc_feature: HIJSMM301CEJHO.5.27.C05.1.454.light.4.raw

SEQ ID NO: 587455 - DNA, 500 bp, Homo sapiens
  misc_feature: HIJSMM301DXOZ9.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagttttattactgtcagcaatactatagtcctcctctcacgttcggcggagggaccaagggtggagatcaaacgaactggtggctgcaccatctgtcttcatcttcccgccatctgac

SEQ ID NO: 587456 - DNA, 483 bp, Homo sapiens
  misc_feature: HIJSMM301EMELP.48.28.C06.1.454.light.4.raw
agtatacatacacgaccggtgctcgatttagagctcacgtattgggtttgggggggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggacccaggctatggatgaggctgactattactgtcaggcgtgggacatcagcagtgaggtggttttcggcggaggggaccaagctgaccgtcctaagtcagcccaaggccg

SEQ ID NO: 587457 - DNA, 522 bp, Homo sapiens
  misc_feature: HIJSMM301C4LF1.49.26.C04.1.454.light.4.raw
agtcgagagacacgaccggtgctcgatttagtctagcgactttgggtttgggggtgggctcaggaggcagagctctgggaatctcaccatggcctggacccctctcctgctccccctcctcactttctgcacagtctctgaggcctcctatgagctgacacagccaccctcggtgtcggtgtccccaggacaaacggccaggataacctgctctggagatgcattgaccaaaaaaatatgcttgttggtaccagaagaagtcaggccaggccccggtgttgctcatctatgacgacagaaaacgaccctccgggatccctgagagattctctggctccacctcagggaccatggccacgttgactatcagcggggcccaggtggaggatgaaggtgactactattgttactcaccagacaccagtgaaaatcacagaggaatattcggcggagggaccaagctgaccgtctaggtcagcccaaggctcgccccctcggtcactctcgttcccaccctcctct

SEQ ID NO: 587458 - DNA, 484 bp, Homo sapiens; identical to SEQ ID NO: 535240
  misc_feature: HIJSMM301D824C.47.60.F05.1.454.light.4.raw

SEQ ID NO: 587459 - DNA, 453 bp, Homo sapiens
  misc_feature: HIJSMM301C85ST.19.86.H09.1.454.light.4.raw
tactctcgtgcacgaccggtgctcgatttagtgctatagacttgggtttgggggccgttcctgggcccagtctgtgctgactcaggcaccctcagcgtctgggacccccgggcagacggtcaccatcgcttgttctgcaagcagctcgaacatcgggagcagtggtgtgatgtggtatcagaaagtcccaggaacggcccccaaactcgtcatctataatgacgctgagcggtccttaagggtccctgaccgattctctggcgagaggtctgacgcctcagcttccctggccatcagagggctccagtctgaagatgaggctgattattactgtgcaatctgggatgacagtgtgaacggtccggttttcggcggagggaccaagctgaccgtcctaagtcagcccaaggctgcccctcggtcactctgttcccaccctcctccacgagagta

SEQ ID NO: 587460 - DNA, 493 bp, Homo sapiens
  misc_feature: HIJSMM301EMN9F.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggaggaccaaggtggagatacaaacgaactgtggctgcaccatctgtcttcatccttcccgccta

SEQ ID NO: 587461 - DNA, 515 bp, Homo sapiens
  misc_feature: HIJSMM301CGSRL.16.66.F11.1.454.light.4.raw
tgtactactccacgaccggtgctcgatttagtcacgcgagaagggtgagaagtagtggagcatccccactatggcctgggctccactacttctcaccctcctcgctcactgcacaggttcttgggccaattttctactgactcagccccactctgtgtcggagtctccggggaagacggtaaccatctcctgcacccgcagcagtggcacctttgccggctattatgtgcagtggttccagcagcgcccgggcagtgcccccaccagagtgatctatgaggataacctacggcccctctggggtccctcctcggttttctggctccatcgacgggtcctccactactgcctccctcaccatctctggactgaagactgaggacgaggctgactactactgtcagtcttatgataacaccagggtggtgttcggcggagggaccaagctggccgtcctaggtcagcccaaggctgccccctcggtcactctgttcccaccctcctcgagtagtaca

SEQ ID NO: 587462 - DNA, 505 bp, Homo sapiens
  misc_feature: HIJSMM301BRAL1.14.86.H09.1.454.light.4.raw
cgtctagtaccacgaccggtgctcgatttagtgctatagacttgggtttgggggaggaactgctcagttaggacccagagggaaccatggcagccccagctcagcttctcttcctcctgctactctggctcccagatatcaccggagaaattgtgttgacacagtctccagccaccctgtctttgtctccaggggaaagagccaccctctcctgcagggccagtcagagtgttagcacctccttagcctggtaccaacagaaacctggccaggctcccagcctcctcatctctgatgcttccaacagggccactggcatcccagccaggttcagtggcagtgggtctgggacagacttcactctcaccatcagctccctagagcctggagattttgtagttttattactgtcagcagtatagcagctggcctcccactttcggcggagggaccaaggtggagatccaacgaactgtggctgcaccatctgtcttcatcttccccg

SEQ ID NO: 587463 - DNA, 505 bp, Homo sapiens; identical to SEQ ID NO: 542298
  misc_feature: HIJSMM301BR7U6.14.3.A03.1.454.light.4.raw

SEQ ID NO: 587464 - DNA, 498 bp, Homo sapiens
  misc_feature: HIJSMM301DJ9G2.43.87.H10.1.454.light.4.raw
tgtgagtagtcacgaccggtgctcgatttagcagtactgcgttgggtttgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagtcctgaggacgaggctgattattactgcaactcacttacaacgaccgacacttgcgtattcggcggcgggaccaagctgaccgtcctaggtcagcccaaggctgccccctcggtcactctgttcccgccctcctcacta

SEQ ID NO: 587465 - DNA, 490 bp, Homo sapiens
  misc_feature: HIJSMM301EJWYD.43.37.D04.1.454.light.4.raw
tgtgagtagtcacgaccggtgctcgatttagtagcatactgttgggtttggggtgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatgacctgcaagtccagtcaaagcctcgttcacagtgatggaaacacctacttgatttggtttcagcagaggccaggccaatctccaaggcgcctaatttataaggtgtctgaccgcgactctggggtcccagacagattcagcggcagtgggtcaggcactgatttcacactgaagatcagcagggtggaggctgaggatgttggggtttattactgcatgcaaggtacacactggcccgtcaccttcggccaagggacacgactggagattaaacgaactgtgg

SEQ ID NO: 587466 - DNA, 508 bp, Homo sapiens
  misc_feature: HIJSMM301CLANS.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggtccaagggaccgaaggtggaaatacaaacgaactagtggctgcaccatctgtcttcatcttccccg

SEQ ID NO: 587467 - DNA, 494 bp, Homo sapiens
  misc_feature: HIJSMM301D98PX.22.29.C07.1.454.light.4.raw
acatacgcgtcacgaccggtgctcgatttagagtgctacgaagggaaaggggaggaactgctcagttaggacccagacggaaccatggaagccccagcgcagcttctcttcctcctgctactctggctcccaggtgccagtgcagaagtagtgatgacgcagtctccaggcaccctgtctgtgtctccaggggaaagagccaccctctcctgcagggccagtcagagtattagcaacaacttagcctggtaccagcagagacctggccaggctcccaggctcctcatctatgttgcatccagcagggccactggtaccccagccaggttcagtggcagtgggtctgggacagagttcactctcaccatcagcagcctgcagtctgaagattttgcagtttattactgtcagcagtataattactggcctcggacgttcggtccagggaccaaggtaggaagtcaaacgaactagtggcgtgcaccatctgtctt

SEQ ID NO: 587468 - DNA, 498 bp, Homo sapiens
  misc_feature: HIJSMM301AKF17.4.57.F02.1.454.light.4.raw
agcactgtagcacgaccggtgctcgatttagctcgatatagttgggtttgggggagccagtctcagtcaggacacagcatggacatgagggtccccgctcagctcctggggctcctgctactctggctccgagatgccagatgtgacacccagatgacccagtctccatcctccctgtctgcatctgtgggagacagagtcatcatctcttgccgggcaagtcagagtgttagtatttatttaaattggtatcagttcaaaccagggaaagcccctaagctcctgatctatgctgcatccagtttacaaagtggggtcccatcaagattcagtggcagtggatctgggacagatttcactctcaccatcagtagtctacaacctgaagtattttgctaacttactactgtcaacagagttacgactacccctccgcctcactttcggcggaggaccgaaggtggaagatacaaacgaactaggtggctgcaccattcc

SEQ ID NO: 587469 - DNA, 485 bp, Homo sapiens
  misc_feature: HIJSMM301CWPYQ.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtccgctcactttcggcggagggaccaagggtggagatacaaacgaa

SEQ ID NO: 587470 - DNA, 494 bp, Homo sapiens
  misc_feature: HIJSMM301EVKDF.52.86.H09.1.454.light.4.raw
cgcagtacgacacgaccggtgctcgatttagtgctatagacttgggtttgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaaccccactgtcactctcg

SEQ ID NO: 587471 - DNA, 508 bp, Homo sapiens; identical to SEQ ID NO: 535649
  misc_feature: HIJSMM301AG628.47.55.E11.1.454.light.4.raw

SEQ ID NO: 587472 - DNA, 463 bp, Homo sapiens; identical to SEQ ID NO: 535062
  misc_feature: HIJSMM301A1NQM.11.73.G07.1.454.light.4.raw

SEQ ID NO: 587473 - DNA, 492 bp, Homo sapiens
  misc_feature: HIJSMM301CFXPJ.3.31.C09.1.454.light.4.raw
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccagcagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgt

SEQ ID NO: 587474 - DNA, 497 bp, Homo sapiens; identical to SEQ ID NO: 536371
  misc_feature: HIJSMM301E0VHC.16.78.H01.1.454.light.4.raw

SEQ ID NO: 587475 - DNA, 478 bp, Homo sapiens; identical to SEQ ID NO: 540986
  misc_feature: HIJSMM301BJWRE.16.86.H09.1.454.light.4.raw

SEQ ID NO: 587476 - DNA, 496 bp, Homo sapiens; identical to SEQ ID NO: 537925
  misc_feature: HIJSMM301E0CI8.22.14.B03.1.454.light.4.raw

SEQ ID NO: 587477 - DNA, 486 bp, Homo sapiens
  misc_feature: HIJSMM301CDR1O.3.33.C11.1.454.light.4.raw
agacgcactccacgaccggtgctcgatttagagtgagctcgttgggtttggggaggaactgctcagttaggacccagacggaaccatggaagccccagcgcagcttctcttcctcctgctactctggctcccagatgccactggagaagtggtgatgacgcagtctccagccaccctgtctgtgtctccaggggaaagagccaccctctcctgcagggccagtcagagtattagcagcaacttagcctggtaccagcagaaacctggccaggctcccaggctcctcatctatgctgcatccaccagggccactggtatcccagccaggttcagtggcagtgggtctgggacagagttcattctcaccatcagcagcctgcagtctgaagattttgcaatttattactgtcagcagtataataactggtggacgttcggccaagggaccaaggtagaaatcaaacgaactgtggctgcaccatctgt

SEQ ID NO: 587478 - DNA, 481 bp, Homo sapiens
  misc_feature: HIJSMM301EAKE6.4.1.A01.1.454.light.4.raw
agcactgtagcacgaccggtgctcgatttagacgtctcatcagggggaggaactgctcagttaggacccagacggaaccatggaagccccagcgcagcttctcttcctcctgctactctggctcccagaatccgctggagaaatcgtagtgacgcagtctccagccaccctgtctgtgtctccaggggagagagccaccctctcctgcagggccaatcagagtattggtcacagcttagcctggtaccagcagaaacctggccaggctcccggtctcctcatctctgctgcgtccatcagggccactggtatccctgccaggttccgtggcagtgggtctgggacagagttcactctcaccatcagcagcctgcagtctgatgatgttgcagtttattactgtcatcaatatggtgaccggccacgttcggccaagggaccaaggtggaaatcaaacgactgtggctgcaccatctgtctt

SEQ ID NO: 587479 - DNA, 492 bp, Homo sapiens
  misc_feature: HIJSMM301D0TSX.49.62.F07.1.454.light.4.raw
agtcgagagacacgaccggtgctcgatttagtagtcgcataaagggaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcacgtcctggtcagccaaggccaacccactgtcact

SEQ ID NO: 587480 - DNA, 507 bp, Homo sapiens
  misc_feature: HIJSMM301BE3XR.14.3.A03.1.454.light.4.raw
cgtctagtaccacgaccggtgctcgatttagagagcgtcacaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccagtagtgacgttggttattataattttgtctcctggtaccaacagcacccaggcaaagcccccaaactcattatttatgaggtcaataatcggccctcaggagtttctaatcgcttctctggctccaagtctggcaacacggcctccctgagcatctctgggctccaggctgaggacgaggctgattattactgcagctcatatactattagcagaactgtggttttcggcggagggaccaaggtgaccggtcctaggtcagcccaaggctgccccctcggtcactcttcg

SEQ ID NO: 587481 - DNA, 488 bp, Homo sapiens
  misc_feature: HIJSMM301BCAQA.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgcctcactttcggcggagggaccgaaaggtggagagtcaaacgaa

SEQ ID NO: 587482 - DNA, 350 bp, Homo sapiens
  misc_feature: HIJSMM301CI5R4.4.67.G01.1.454.light.4.raw
agcactgtagcacgaccggtgctcgatttagagtatacatattggttactatgactttgtctcgtggtaccaacaacacccaggcaaagccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagtgaccgtcctgggtcagcccaaggccaacccactgtcactctgttcccgccctcctcctacagtgct

SEQ ID NO: 587483 - DNA, 496 bp, Homo sapiens; identical to SEQ ID NO: 545357
  misc_feature: HIJSMM301A5VAM.43.49.E05.1.454.light.4.raw

SEQ ID NO: 587484 - DNA, 509 bp, Homo sapiens; identical to SEQ ID NO: 549778
  misc_feature: HIJSMM301AXD8G.17.33.C11.1.454.light.4.raw

SEQ ID NO: 587485 - DNA, 496 bp, Homo sapiens; identical to SEQ ID NO: 537925
  misc_feature: HIJSMM301B9ACO.22.14.B03.1.454.light.4.raw

SEQ ID NO: 587486 - DNA, 476 bp, Homo sapiens
  misc_feature: HIJSMM301ELWJF.7.81.H04.1.454.light.4.raw
  modified_base (410)..(410): a, c, t, g, unknown or other
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacanagttccactaccccaatcactttcggccctgggactgaagtgcatatgaagagaactgtggctgca

SEQ ID NO: 587487 - DNA, 488 bp, Homo sapiens; identical to SEQ ID NO: 537260
  misc_feature: HIJSMM301CUE5Y.47.70.G04.1.454.light.4.raw

SEQ ID NO: 587488 - DNA, 492 bp, Homo sapiens; identical to SEQ ID NO: 537666
  misc_feature: HIJSMM301AM0T1.43.33.C11.1.454.light.4.raw

SEQ ID NO: 587489 - DNA, 502 bp, Homo sapiens
  misc_feature: HIJSMM301EKGQ5.48.53.E09.1.454.light.4.raw
agtatacatacacgaccggtgctcgatttagagagagtgtgttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcagcaacttagcctggtaccagcaaaaacctggccaaactcccaggctcctcatctatggtgcatccaccagggccactggaatcccaaccaggttcagtggcagagggtctgggacggaattcactctcaccatcagcagtctgcagtctgaagattttgcagtttattattgtcagcagtataataattggcctccgggggtcactttcggcctgggaccaaataaatagtcaatcgaactgtggctgcaccatctgtcttcatt

SEQ ID NO: 587490 - DNA, 486 bp, Homo sapiens; identical to SEQ ID NO: 535043
  misc_feature: HIJSMM301D14SK.46.35.D02.1.454.light.4.raw

SEQ ID NO: 587491 - DNA, 507 bp, Homo sapiens
  misc_feature: HIJSMM301DRERO.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccagccccactgtcact

SEQ ID NO: 587492 - DNA, 488 bp, Homo sapiens; identical to SEQ ID NO: 546278
  misc_feature: HIJSMM301B4NCX.43.33.C11.1.454.light.4.raw
  modified_base (364)..(364): a, c, t, g, unknown or other

SEQ ID NO: 587493 - DNA, 489 bp, Homo sapiens
  misc_feature: HIJSMM301A9TG2.40.22.B11.1.454.light.4.raw
tctagcgactcacgaccggtgctcgatttagacgacagctcaggggctgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgaatagtaatggatacaactatttggattggtacctgcagaagccagggcagtgtccacagctcctgatctatttgggttctaatcgggcctccggggtccctgacaggttcagtggcagtggatcaggtacagattttacactgaaaatcagcagggtggaggcagaagatgttgggatttattactgcatgcaacctctacaaactgtgtggacggtcggccaagggaccaaggtggaaatcaagcgaactgtggctgca

SEQ ID NO: 587494 - DNA, 498 bp, Homo sapiens
  misc_feature: HIJSMM301BK9GE.48.24.C02.1.454.light.4.raw
agtatacatacacgaccggtgctcgatttagtacagatcgttagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctaccaaagcctacctcatcaagtatgcttccgagtccatctctggggtccctcgaggttcagtggcagtggatctgggacagatttcaccctcaccatcaatagcctggaagctgaagatgctgcaacctattactgtcatcagacttttagttacgtcggaccttcggccaagggacacgactggagattaacgaactgtggctgcacatctgtctcatcttcccg

SEQ ID NO: 587495 - DNA, 518 bp, Homo sapiens; identical to SEQ ID NO: 535407
  misc_feature: HIJSMM301D0HV5.22.30.C08.1.454.light.4.raw

SEQ ID NO: 587496 - DNA, 505 bp, Homo sapiens
  misc_feature: HIJSMM301B4F4X.4.72.G06.1.454.light.4.raw
agcactgtagcacgaccggtgctcgatttagctacgactgcaagggaaagggggaggaactgctcagttaggacccagacggaaccatggaagccccagcgcagcttctcttcctcctgctactctggctcccagaaagcagtggagaagtagtgatgacgcagtctccagccaccctgcctgtgtctccaggggacactgccaccctctcctgcagggccagtcagagtgttggcactaatttagcctggtaccagcagaaacctggccaagctcccaggctgctcatctataatacaatcacaagggacattggtgtcccagacaggttcagcggcagtgggtctgggacagagttcactctcactatcagcagcctgcactttgaagattttgcagtctatcattgtcagcagtataattggtggcctcggacgttcggtccgaagggaccgaacggtaggaaagtacaaacgaaacctagttggcgtgcgaccactcttcg

SEQ ID NO: 587497 - DNA, 501 bp, Homo sapiens
  misc_feature: HIJSMM301DD229.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggcctcctcatctatggtgcatccaccagggccactggtatcccagccaggttcagtggcagtgggtctgggacagagttcactctcaccatcagcagcctgcagtctgaagtattttgcggttttattactgtcagcagtataataactggcctccacggtactacttttggccaggggaccaagctggagatcaaacgaactgtggctgcaccatctgtt

SEQ ID NO: 587498 - DNA, 522 bp, Homo sapiens
  misc_feature: HIJSMM301DHP2V.43.59.F04.1.454.light.4.raw
tgtgagtagtcacgaccggtgctcgatttagtacacacacttagggattggggggggtcgtcaggaggcagcgctctcgggacggtctccaccatggcctgggcgtctgctattcctcaccctcctcactcagggcacagggtcctgggcccgagtctgccctgactcagcctgcctccgtgtctgggtctcctggacagtcgatcaccatctcctgcactggaagtagcagtgacgttggaacttatgaccatgtctcctggtaccaacaatacccaggcaaagcccccaaactcttgatttatgatgtcacttatcggccctcaggggtttcttatcgcttctctggctccaagtctggcaacacggcctccctgaccatctctgggctccaggctgaggacgaggctgattattactgcaactcacttacaacgaccgacacttgcgtattcggcggcgggaccaagctgaccgtcctaggtcagcccaaggctgccccctcggtcactctgttccccg

SEQ ID NO: 587499 - DNA, 478 bp, Homo sapiens
  misc_feature: HIJSMM301CSIVE.5.70.G04.1.454.light.4.raw
atcagacacgcacgaccggtgctcgatttagtgtagtgtgaagggaaagggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgactgtggctgca

SEQ ID NO: 587500 - DNA, 419 bp, Homo sapiens
  misc_feature: HIJSMM301CO3NR.18.78.H01.1.454.light.4.raw
tacgagtatgcacgaccggtgctcgatttagtgtgagtagtttgggtttgggggctttgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtcctaggtcagcccaaggccaaccccactgtcactctgttcccgccctcctccatactcgta

SEQ ID NO: 587501 - DNA, 494 bp, Homo sapiens; identical to SEQ ID NO: 535497
  misc_feature: HIJSMM301AZ3YG.43.72.G06.1.454.light.4.raw

SEQ ID NO: 587502 - DNA, 504 bp, Homo sapiens; identical to SEQ ID NO: 574831
  misc_feature: HIJSMM301DQ9B5.19.78.H01.1.454.light.4.raw

SEQ ID NO: 587503 - DNA, 514 bp, Homo sapiens
  misc_feature: HIJSMM301A8PVS.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtggaagtcaagcgaactcgtggctgcaccatctgtcttcatccttcccgtccactc

SEQ ID NO: 587504 - DNA, 501 bp, Homo sapiens; identical to SEQ ID NO: 579640
  misc_feature: HIJSMM301BB81N.9.81.H04.1.454.light.4.raw

SEQ ID NO: 587505 - DNA, 501 bp, Homo sapiens
  misc_feature: HIJSMM301D4H7L.21.8.A08.1.454.light.4.raw
tcgtcgctcgcacgaccggtgctcgatttagcatactctacagggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagattcattgccaaaagaatatacttgttggttccagcagaagtcaggccaggcccctgtactggtcatccatgaggccagtcgacgacactccgggatccctgagagattctctgcctccagctcagggacagtggccaccttgactatcagtggggcccaggtggacgatgaagctgactactattgttacgcaccagacagtagtggtcatcagggggtattcgggcggagggaccaagttgaccgtccttggtcagcccaaggctcgccccctcggtcactctcg

SEQ ID NO: 587506 - DNA, 499 bp, Homo sapiens
  misc_feature: HIJSMM301BTVG5.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctcgggaccaaacgtaggagatcaaacgaactagtggctgcaccatctgtcttt

SEQ ID NO: 587507 - DNA, 508 bp, Homo sapiens
  misc_feature: HIJSMM301CV6GR.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggcctcaggggtatctaatcgcttctctggctccaagtctggcaacacggcctccctgaccgtctctggcctccagactgaggacgaggctgattattactgccactcatatagaagtagtactactcctgtggttttcggcggagggaccaagctgaccgtcctaggtcagcccaaggctgccccctcggtcactctgtt

SEQ ID NO: 587508 - DNA, 478 bp, Homo sapiens
  misc_feature: HIJSMM301B1QON.18.76.G10.1.454.light.4.raw
tacgagtatgcacgaccggtgctcgatttagtcactcatacagggggcaggagtcagtcccaaccaggacacagcatggacatgagggtccctgctcagctcctggggctcctgctgctctggctctcaggtgccagatgtgacatccagatgacccagtctccagcctccctgtcagcatctgtaggagacagagtcaccatcacttgccaggcgagtcaagacactgacaagtttgtgaattggtatcagcagaaaacagggacagcccctaagctcctaatctacgatgcgtctcatttgcagacaggggtcccaccaaggttcagcggaagtggatctgggacagattttaatttcaccatcagcagcctccaacgtgatgatgttgcaacatactattgtcagcaatatgattttgcttcctccgagtgccacttttggcggggggtaccgaaggtggacgatcgaaacgaaa

SEQ ID NO: 587509 - DNA, 494 bp, Homo sapiens
  misc_feature: HIJSMM301AOKUY.13.67.G01.1.454.light.4.raw
tcacgtactacacgaccggtgctcgatttagagtatacatattgggtttgggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagtgggtctgggacagatttcactctcaccatcagcagcctgcaggctgaagatgtggcagtttattactgtcagcaatattatagtactcctccgaggctcactttcggcggagggaccaaggtggagatcaaacgaact

SEQ ID NO: 587510 - DNA, 495 bp, Homo sapiens
  misc_feature: HIJSMM301EKZK4.22.27.C05.1.454.light.4.raw
acatacgcgtcacgaccggtgctcgatttagacgcgatcgaagggtttgggggctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaagaactgtggctgcacc

SEQ ID NO: 587511 - DNA, 491 bp, Homo sapiens
  misc_feature: HIJSMM301BBU8W.16.53.E09.1.454.light.4.raw
  modified_base (476)..(476): a, c, t, g, unknown or other
tgtactactccacgaccggtgctcgatttagagagagtgtgttgggtttggggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatcgtactttgggttctaatcgggcctccggggtccctgacaggttcagtggcagtggatcaggcacagattttacactgaaaatcagcagagtggaggctgaggatgttggggttattactgcatgcaagctctacaactccttacacttttggccagggaccaagctggngatcaaacgaactgt

SEQ ID NO: 587512 - DNA, 486 bp, Homo sapiens; identical to SEQ ID NO: 535290
  misc_feature: HIJSMM301D9DPI.3.12.B01.1.454.light.4.raw

SEQ ID NO: 587513 - DNA, 508 bp, Homo sapiens
  misc_feature: HIJSMM301CMEJ2.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaacgggaccgaacggtggaaatacaaacgaaactgtggctgcgaccatctgtcttcatcttccccg

SEQ ID NO: 587514 - DNA, 499 bp, Homo sapiens; identical to SEQ ID NO: 562784
  misc_feature: HIJSMM301ECN8G.40.23.C01.1.454.light.4.raw

SEQ ID NO: 587515 - DNA, 441 bp, Homo sapiens; identical to SEQ ID NO: 534971
  misc_feature: HIJSMM301CJSAB.11.3.A03.1.454.light.4.raw

SEQ ID NO: 587516 - DNA, 483 bp, Homo sapiens
  misc_feature: HIJSMM301AJUM4.13.39.D06.1.454.light.4.raw
tcacgtactacacgaccggtgctcgatttagtgacatctcgcagttctttggggtgctggggtctcaggaggcagcgctctcaggacatctccaccatggcctgggctctgctgctcctcaccctcctcactcagggcacagggtcctgggcccagtctgccctgactcagcctgcctccgtgtctggctctcctggacagtcgatcatcgtctcctgcactggaaccagcactgatgttggtggttataactatgtctcctggtatcaacaacacccaggcaaagcccccaaactcatcatttatgaagtcatttatcggccctcagggatttctaatcgcttctctggctccaagtctggcaacacggcctccctgaccatctctgggctccaggctgaagacgaggctgattattactgcagctcatatacaaccatcaacacacagtcttcggaagtgggaccaaacgtacaccgtcct

SEQ ID NO: 587517 - DNA, 486 bp, Homo sapiens; identical to SEQ ID NO: 535043
  misc_feature: HIJSMM301CBQ23.46.35.D02.1.454.light.4.raw

SEQ ID NO: 587518 - DNA, 496 bp, Homo sapiens; identical to SEQ ID NO: 536326
  misc_feature: HIJSMM301AU9RK.16.12.B01.1.454.light.4.raw

SEQ ID NO: 587519 - DNA, 496 bp, Homo sapiens
  misc_feature: HIJSMM301E083W.3.71.G05.1.454.light.4.raw
agacgcactccacgaccggtgctcgatttagtgtcgtcgcaagagagagggggcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaagctattatgcaagctggtaccagcagaagccaggacaggcccctgtacttgtcatctatggtaaaaacaaccggccctcagggatcccagaccgattctctggctccagctcaggaaacacagcttccttgaccatcactggggctcaggcggaagatgaggctgactattactgtaactcccgggccagcagtggtaacattgtgatattcggcggaggaccaaggtgaccgtcctacgtcagcccaaggctgccccctcggtcactctcg

SEQ ID NO: 587520 - DNA, 486 bp, Homo sapiens; identical to SEQ ID NO: 535043
  misc_feature: HIJSMM301ARGHW.46.35.D02.1.454.light.4.raw

SEQ ID NO: 587521 - DNA, 497 bp, Homo sapiens
  misc_feature: HIJSMM301ATPG2.40.70.G04.1.454.light.4.raw
tctagcgactcacgaccggtgctcgatttagtgtagtgtgaagggaaagggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccggagtgttttgtacagctccaacaataagaattacttagcttggtatcagcagagaccagggcagcctcctgagttgctcatttactgggcatctacccgggaatccggggtccctgaccgattcagtggcagcgggtctgggacagatttcactctcaccatcagcagcctgcaggctgaagatgtggcactttattactgtcagcaatattttagtattccgttcacttttcggcggagggaccaaggtggagatcaaacgaactgtggctgca

SEQ ID NO: 587522 - DNA, 494 bp, Homo sapiens; identical to SEQ ID NO: 535276
  misc_feature: HIJSMM301AKPTE.16.6.A06.1.454.light.4.raw

SEQ ID NO: 587523 - DNA, 487 bp, Homo sapiens
  misc_feature: HIJSMM301AYG7P.43.53.E09.1.454.light.4.raw
tgtgagtagtcacgaccggtgctcgatttagagagagtgtgttgggtttgggggcagaagtctctctcagtcaggacacagcatggacatgagggtccctgctcagctcctgggactcctgctgctctggctcccagattccagatgtgacatccagatgacccagtcgccagcctccctgtctgcaagtgtgggagacagagtcacccttttttgccgggcgagtcggcccattgacgactgtttggcctggtatcgcgtgagacccagggcaacctcctcaacttctgatataccgttcatcgctgttgcacgttggggtcccacctcggttcagtggcaacggctctgagacagatttttctctcgtcatcactggtctacagtctgacgacggcgcaatgtacttctgtcaacactatgcctctccccctacaatttcggtcagggaccaagttgaacatcaatcgaactgtggctgcaccat

SEQ ID NO: 587524 - DNA, 504 bp, Homo sapiens; identical to SEQ ID NO: 535935
  misc_feature: HIJSMM301A2AUK.18.78.H01.1.454.light.4.raw

SEQ ID NO: 587525 - DNA, 508 bp, Homo sapiens
  misc_feature: HIJSMM301B6F1Q.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttcncgggcgttcggccaagggaccgaaggtggaaagtacaaacgaactagtggcgtgcaccatctgtcttcatccttccccg

SEQ ID NO: 587526 - DNA, 517 bp, Homo sapiens
  misc_feature: HIJSMM301BO5QH.15.34.D01.1.454.light.4.raw
tctacgtagccacgaccggtgctcgatttagatcgtctgtgttgggtttgggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaagctgccctcaccatcacgggggcccaggcagacgatgaatgtgattatcactgcgtcctttatgtgggcgtgggcagtttgggtgttcggcggagggaccaaactgaccgtcctaggtcagcccaaggctgccccctcggtcactcttccg

SEQ ID NO: 587527 - DNA, 490 bp, Homo sapiens
  misc_feature: HIJSMM301CLKH6.41.44.D11.1.454.light.4.raw
tctatactatcacgaccggtgctcgatttagcgcagtacgaagggggcgggggtaagaggttgtgtccaccatggcctggactcctctcctcctcctgttcctctctcactgcacaggttccctctcgcaggctgtgctgactcagccgtcttccctctctgcatctcctggagcatcagtcagtctcacctgcaccttgcgcagtggcatcgatgttaataggtacacgatatattggtaccagaggaggccagggagtcctccccaatttctcctgagctacaagtcacagtcagatacacagcggggctctggagtccccagacgcttctctggattcaaagatgtttcggccaatgcaggcattttagtcatctctgggtccagtttgtggatgaggctgactactattgcacggtctggtacagcagcgctgtggtcttcggcggagggactgaacttatcgtcctaggtcagcccaaggctccg

SEQ ID NO: 587528 - DNA, 498 bp, Homo sapiens
  misc_feature: HIJSMM301C2YMY.41.19.B08.1.454.light.4.raw
tctatactatcacgaccggtgctcgatttagtgagtcagtaagggggggtcgacaagaggcagcgctctcgggacggtctccaccatggcctgggctctgctgctcctcactctcctcactcaggacacagggtcctgggcccagtctgccctgactcagcctgactccgtgtctgggtctcctggacagtcgatcaccatctcctgcactggaaccagcagtgacgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctaggtcagcccaaggctgccccccg

SEQ ID NO: 587529 - DNA, 504 bp, Homo sapiens; identical to SEQ ID NO: 540636
  misc_feature: HIJSMM301DXM5P.19.67.G01.1.454.light.4.raw

SEQ ID NO: 587530 - DNA, 496 bp, Homo sapiens
  misc_feature: HIJSMM301BQKW4.3.33.C11.1.454.light.4.raw
  modified_base (488)..(488): a, c, t, g, unknown or other
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccaccctcctcgngtgcgtct

SEQ ID NO: 587531 - DNA, 471 bp, Homo sapiens; identical to SEQ ID NO: 537461
  misc_feature: HIJSMM301AZBKB.7.81.H04.1.454.light.4.raw

SEQ ID NO: 587532 - DNA, 495 bp, Homo sapiens; identical to SEQ ID NO: 557386
  misc_feature: HIJSMM301DBZRU.27.78.H01.1.454.light.4.raw

SEQ ID NO: 587533 - DNA, 454 bp, Homo sapiens; identical to SEQ ID NO: 534964
  misc_feature: HIJSMM301CYTTB.19.86.H09.1.454.light.4.raw

SEQ ID NO: 587534 - DNA, 476 bp, Homo sapiens
  misc_feature: HIJSMM301DVCHV.51.44.D11.1.454.light.4.raw
cgatcgtatacacgaccggtgctcgatttagcgcagtacgaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcaattgccgggcaagtcagagcattagcaggtatttaaattggtatcagcagaaaccagggaaagcccctaaggtcctgatctatgctgcatccagtttgcaaagtgggtcccatcaaggttcagtggcagtggatctgggacggatttcactctcaccatcagcagtctgcaacttgcagattctgcaacttactattgtcaacagagtttcaattcccctcgcacgttcggccaagggaccaaggtggaaatcaaacgaactgtggctgcaccat

SEQ ID NO: 587535 - DNA, 511 bp, Homo sapiens
  misc_feature: HIJSMM301D5L18.17.2.A02.1.454.light.4.raw
cgtagactagcacgaccggtgctcgatttagactcatctacagggggggtagagaagacaggactcaggacaatctccagcatggccagcttccctctcctcctcaccctcctcactcactgtgcagggtcctgggcccagtctgtactgactcagccaccctcagcgtctgggacccccggacagagggtcaccatctcttgttctggaagcagctccaacatcgggactaatactgtaacctggttccagcacgtcccaggaacggtccccaaactcgtcatgtataattatagtcagcggccctcaggggtccctgaccgattcgctggctccaactctggcacctcagcctccctggccatcagtgggctccagtctgaggatgaggctgattattactgtgcagcatgggatgccagcctgagtagtcccgtcttcggaactgggaccaaggtcaccgtcctacgtcagcccaaggccaaccccactgtcactctgttcccaccct

SEQ ID NO: 587536 - DNA, 447 bp, Homo sapiens; identical to SEQ ID NO: 535020
  misc_feature: HIJSMM301CLW3Z.18.9.A09.1.454.light.4.raw

SEQ ID NO: 587537 - DNA, 506 bp, Homo sapiens
  misc_feature: HIJSMM301DXL3K.5.59.F04.1.454.light.4.raw
atcagacacgcacgaccggtgctcgatttagtacacacacttagggattgggggaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggtatcccagccaggttcagtggcagtgggtctgggacagagttcactctcaccatcagcagcctgcagtctgaagattttgcagtttattactgtcaacagtataatgactggtggacgttcggccaagggaccaaggtggagaccaaacgaactgtggctgcaccatctgtcttcatcttcccgcct

SEQ ID NO: 587538 - DNA, 484 bp, Homo sapiens; identical to SEQ ID NO: 537689
  misc_feature: HIJSMM301AXIKN.19.71.G05.1.454.light.4.raw

SEQ ID NO: 587539 - DNA, 508 bp, Homo sapiens
  misc_feature: HIJSMM301E0GKJ.13.53.E09.1.454.light.4.raw
tcacgtactacacgaccggtgctcgatttagagagagtgtgttgggtttgggggcaggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcgtccacggaccgaacggtaggaaagtacaagacgaaccgtagtggcgtgcaccactctcgtcttct

SEQ ID NO: 587540 - DNA, 492 bp, Homo sapiens; identical to SEQ ID NO: 537395
  misc_feature: HIJSMM301A8ZZN.16.73.G07.1.454.light.4.raw

SEQ ID NO: 587541 - DNA, 497 bp, Homo sapiens
  misc_feature: HIJSMM301B2YT1.48.76.G10.1.454.light.4.raw
agtatacatacacgaccggtgctcgatttagtcactcatacaggggagtcagacccagtcaggacacagcatggacatgagggtccccgctcagctcctggggctcctgctgctctggctcccaggtgccaaatgtgacatccagatgacccagtttccttccaccctgtctacatttgtgggagacagagtcagtatcagttgccgggccagtcagagtattactaggtggttggcctggtatcagcagagaccagggaaagcccctaagctcctaatccaagaggcatccaccttagaagttggggtcccgtcacggttcagcggcagcgggtctgggacagcgttcactctcaccatcagcggcctgcagtctgatgattttgcaacttattactgccaacagtatagtacttatccgtacacttttggccaggggaccaagctggagatcaaacgaactgtggctgcaccatctgtcttcatcttcccgccta

SEQ ID NO: 587542 - DNA, 491 bp, Homo sapiens; identical to SEQ ID NO: 553956
  misc_feature: HIJSMM301EOGYL.4.22.B11.1.454.light.4.raw

SEQ ID NO: 587543 - DNA, 486 bp, Homo sapiens; identical to SEQ ID NO: 535043
  misc_feature: HIJSMM301ESJZF.46.35.D02.1.454.light.4.raw

SEQ ID NO: 587544 - DNA, 507 bp, Homo sapiens; identical to SEQ ID NO: 584793
  misc_feature: HIJSMM301A2W94.17.41.D08.1.454.light.4.raw

SEQ ID NO: 587545 - DNA, 519 bp, Homo sapiens; identical to SEQ ID NO: 547780
  misc_feature: HIJSMM301AQT77.5.27.C05.1.454.light.4.raw

SEQ ID NO: 587546 - DNA, 498 bp, Homo sapiens
  misc_feature: HIJSMM301B84K9.14.23.C01.1.454.light.4.raw
cgtctagtaccacgaccggtgctcgatttagtacacgtgattagggattgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagaagcaacttagcctggtaccagcagaaacctggccaggctcccaggctcctcatctatggtgcatccaccagggccactggtgtcccagccaggttcagtggcagtgggtctgggacagagttcactctcaccatcagcagcctgcagtctgaagattttgcaacttactactgtcaacagagttacagtacccccctcactttcggcggagggaccaaggcggagatcagacgaactgtggctgcaccatctgtcttcatcc

SEQ ID NO: 587547 - DNA, 502 bp, Homo sapiens; identical to SEQ ID NO: 541971
  misc_feature: HIJSMM301BD48S.4.39.D06.1.454.light.4.raw

SEQ ID NO: 587548 - DNA, 486 bp, Homo sapiens; identical to SEQ ID NO: 564374
  misc_feature: HIJSMM301A96B5.4.26.C04.1.454.light.4.raw

SEQ ID NO: 587549 - DNA, 504 bp, Homo sapiens; identical to SEQ ID NO: 535077
  misc_feature: HIJSMM301A3P6B.8.28.C06.1.454.light.4.raw

SEQ ID NO: 587550 - DNA, 494 bp, Homo sapiens; identical to SEQ ID NO: 534992
  misc_feature: HIJSMM301AIJQE.9.1.A01.1.454.light.4.raw

SEQ ID NO: 587551 - DNA, 496 bp, Homo sapiens; identical to SEQ ID NO: 536248
  misc_feature: HIJSMM301EU6XZ.22.27.C05.1.454.light.4.raw

SEQ ID NO: 587552 - DNA, 495 bp, Homo sapiens
  misc_feature: HIJSMM301C2IPP.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagccaaggctgcccctc

SEQ ID NO: 587553 - DNA, 497 bp, Homo sapiens
  misc_feature: HIJSMM301CS2A7.40.44.D11.1.454.light.4.raw
tctagcgactcacgaccggtgctcgatttagcgcagtacgaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaacagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcagtttattactgtcagcagtataataactgccgctcactttcgtcggagggacgaacggtaggagaccaaacgaaacacgtggcgtcgcaccactactgtcttctat

SEQ ID NO: 587554 - DNA, 505 bp, Homo sapiens
  misc_feature: HIJSMM301AMFJP.11.67.G01.1.454.light.4.raw
cgagagataccacgaccggtgctcgatttagagtatacatattgggtttgggggggttgagaagacaggactcaggacaatctccagcatggccagcttccctctcctcctcaccctcctcactcactgtgcagggtcctgggcccagtctgttctgactcagccaccctcagcgtctgggacccccgggcagagaatcaccatctcttgtactggaagcagctccaatatcggaagtaacgatgtcaattggtatcaacatctccccggtacggcccccaaactcctcatctataggaatagccagcggccctcaggggtccctggccgattctctggctcgaagtctggcacctcagcctccctggcctgcagtgggctccagtctgaggatgaggctgactattattgtgcagcgtgggatgacggtctgagtgctgtggtcttcggcggagggaccaagctgaccgtcctgggtcagcccaaggctgccccctggtcactc

SEQ ID NO: 587555 - DNA, 444 bp, Homo sapiens
  misc_feature: HIJSMM301DMID0.9.9.A09.1.454.light.4.raw
tgatacgtctcacgaccggtgctcgatttagcgagacgcgcagggtcctgggcccagtctgtgctgacgcagccgccctcagtgtctggggccccagggcagagggtcaccatctcctgcactgggagcagctccaacatcgggaatcgctatgttgtacactggtaccagcagcttccaggaacagtccccaaaccctcatctatggtaatagtaatcggccctcaggggtccctgaccgattctctggctccaagtctggcacctcagcctccctggccatcactgggcttcaggctgaggatgaggctgattattactgccactcctatgacagcagcctgagaagtgtggtattcgggcggagggaccaagctgaccgtcctaggtcagcccaaggctgccccctcggtcactctgttcccaccctcctcagacgtatca

SEQ ID NO: 587556 - DNA, 500 bp, Homo sapiens
  misc_feature: HIJSMM301EWL99.48.37.D04.1.454.light.4.raw
agtatacatacacgaccggtgctcgatttagtagcatactgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgaccgtctaagtcagcccaaggctgccccctcggtcta

SEQ ID NO: 587557 - DNA, 493 bp, Homo sapiens
  misc_feature: HIJSMM301BTONU.16.71.G05.1.454.light.4.raw
tgtactactccacgaccggtgctcgatttagtgtcgtcgcaagagagaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttaccagcaggtacttagcctggtaccagcagaaacctggcctggctcccaggctcctcatctatggtgcatccagcagggccactggcatcccagacaggttcagtggcagtgggtctgggacagacttcactctcaccctcagcagactggagcctgaagattttgcagtgtattactgtcagcagtatggtagggcaccttacacttttggccaggggaccaagctggagatcaaacgaactgtggctgcaccatctgtctt

SEQ ID NO: 587558 - DNA, 490 bp, Homo sapiens; identical to SEQ ID NO: 535234
  misc_feature: HIJSMM301CYPAW.17.21.B10.1.454.light.4.raw

SEQ ID NO: 587559 - DNA, 497 bp, Homo sapiens
  misc_feature: HIJSMM301BWDXZ.5.12.B01.1.454.light.4.raw
atcagacacgcacgaccggtgctcgatttagtagtgtagattccgcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcggatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggaccaagctgaccgtcctgagtcagcccaaggctccg

SEQ ID NO: 587560 - DNA, 496 bp, Homo sapiens
  misc_feature: HIJSMM301CJRVI.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctcctgaccatctctgggctccaggctgaggacgagggtgattattactgcagctcatatagaagtggcagcactctcgtattcggcggtgggaccaaggctgaccgtcctaggtcagcccaaggctgccccctc

SEQ ID NO: 587561 - DNA, 488 bp, Homo sapiens; identical to SEQ ID NO: 535861
  misc_feature: HIJSMM301CABPP.14.55.E11.1.454.light.4.raw

SEQ ID NO: 587562 - DNA, 489 bp, Homo sapiens
  misc_feature: HIJSMM301AYTEV.17.36.D03.1.454.light.4.raw
cgtagactagcacgaccggtgctcgatttagctgcgtcacgatctctcttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagagtgttagcagctacttagcctggtaccaacagaaacctggccagtctcccaggctcctcatctatgatgcatccaacagggccactggcatcccagccaggttcagtggcagtgggtctgggacagacttcattctcaccatcagcagcctagagcctgaagattttgcagtttattactgtcagcagcgtagcaactggctcatccaccttcggccaagggacacgactggagatagaaacgaactgtggctgcaccta

SEQ ID NO: 587563 - DNA, 493 bp, Homo sapiens
  misc_feature: HIJSMM301B3AAP.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacgactggagattaaaggaactgtggctgcaccatctgtcttcattcctccc

SEQ ID NO: 587564 - DNA, 506 bp, Homo sapiens
  misc_feature: HIJSMM301AGA9K.4.39.D06.1.454.light.4.raw
agcactgtagcacgaccggtgctcgatttagtgacatctcgcagttctttgggggggggtctcaggaggcagcgctctcaggacgtcaccaccatggcctgggctctgctcctcctcaccctcctcactcggggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcggagggaccaaactgaccgtcctaggtcagcccaaggctgccccctcggt

SEQ ID NO: 587565 - DNA, 491 bp, Homo sapiens; identical to SEQ ID NO: 535194
  misc_feature: HIJSMM301B6KGS.26.78.H01.1.454.light.4.raw

SEQ ID NO: 587566 - DNA, 498 bp, Homo sapiens; identical to SEQ ID NO: 586601
  misc_feature: HIJSMM301DDG7G.12.87.H10.1.454.light.4.raw

SEQ ID NO: 587567 - DNA, 483 bp, Homo sapiens; identical to SEQ ID NO: 566894
  misc_feature: HIJSMM301EKN3O.46.35.D02.1.454.light.4.raw

SEQ ID NO: 587568 - DNA, 488 bp, Homo sapiens
  misc_feature: HIJSMM301BSC78.12.31.C09.1.454.light.4.raw
atacgacgtacacgaccggtgctcgatttagacgtctcatcaaggaaggaagggggcaggagtcagtctcagtcaggtcacagcatggacatgagggtccccgctcagctcctggggctcctgctactctggctccgaggtgccagatgtgacatccagctgacccagtctccatcctccctgtctgcatctgtaggagacaaagtcaccatcacttgccgggctaacgagagtattgccacgtatttaaattggtatcaacaaaaagcaggcaaagtcccaaagctcctgatttatgctgccaccagtctgcaaggtgggttcccgtcaaggttcactggccgtggatcagggacagaatttactctcaccatcagtagtctacagcctgaagatattgcttacttattactgtcagcagagttaccgcgctcccatcactttcggccaaggacacgaccgcagattggacgaactgtggctgcacc

SEQ ID NO: 587569 - DNA, 498 bp, Homo sapiens
  misc_feature: HIJSMM301A4Y7O.22.14.B03.1.454.light.4.raw
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagtattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagatgtggcagtttattattgtcagcaatattatattcctcctcagacgttcggccaagggaccaaaggtggaaatcaaacgaactagtggctgcacc

SEQ ID NO: 587570 - DNA, 507 bp, Homo sapiens
  misc_feature: HIJSMM301DAQJ5.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcgggggaccaagctgaccgtcctaggtcagcccaaggctcgtcccccg

SEQ ID NO: 587571 - DNA, 485 bp, Homo sapiens
  misc_feature: HIJSMM301ATZKY.10.53.E09.1.454.light.4.raw
catagtagtgcacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctgcctgtgtctctgggcgagagggccaccatcaactgcaagtccagccagagtgttttattcagctccgacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgcggcagtttattactgtcagcactattatagtaccccattcacattcggccctgggaccaaagtggagatcaaacga

SEQ ID NO: 587572 - DNA, 519 bp, Homo sapiens
  misc_feature: HIJSMM301CV3YO.48.61.F06.1.454.light.4.raw
agtatacatacacgaccggtgctcgatttagctacgctctaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccaccct

SEQ ID NO: 587573 - DNA, 506 bp, Homo sapiens; identical to SEQ ID NO: 535404
  misc_feature: HIJSMM301DADCL.10.88.H11.1.454.light.4.raw

SEQ ID NO: 587574 - DNA, 484 bp, Homo sapiens; identical to SEQ ID NO: 535400
  misc_feature: HIJSMM301BZ2YG.46.26.C04.1.454.light.4.raw

SEQ ID NO: 587575 - DNA, 494 bp, Homo sapiens; identical to SEQ ID NO: 534992
  misc_feature: HIJSMM301B3MP5.9.1.A01.1.454.light.4.raw

SEQ ID NO: 587576 - DNA, 482 bp, Homo sapiens
  misc_feature: HIJSMM301D4CM7.40.73.G07.1.454.light.4.raw
tctagcgactcacgaccggtgctcgatttagctctacgctcagggcacgaccggtgctcgatttagagagcgtcacagagagaagggggaagtctctctcagtcaggacacagcatggacatgagggtccctgctcagctcctgggactcctgctgctctggctcccagatactagatgtgacatccagatgacccagtctccaccctccctgtctgcatctgtcggagacaaagtcaccatcacttgccgggcgagtcaagtcattagcaattatttagcctggtatcagcagaaaccagggcaaggtcctaaactcctgatctacgctgcatccactttgcactcgacgggtcccatctcggttcaccggcagtggatcgtgggacagtatttcactctcatcatcagcagcctgcagcctggaggatgttgctaacttattactgtacaaaagtataacattcgtcccccttctacccg

SEQ ID NO: 587577 - DNA, 501 bp, Homo sapiens; identical to SEQ ID NO: 553272
  misc_feature: HIJSMM301BFRPH.43.34.D01.1.454.light.4.raw

SEQ ID NO: 587578 - DNA, 513 bp, Homo sapiens
  misc_feature: HIJSMM301CV1FL.52.72.G06.1.454.light.4.raw
cgcagtacgacacgaccggtgctcgatttagctacgactgcaagggaaaggggggggtcgtcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcaatgacattggtacttataattctgtctcctggtaccaacaataccccggcaaagtccccaaactcatgatctttgaggtcagtgatcggcccgcaggggtttctcatcgcttctccggctccaagtctggcagcacggcctccctgaccatctctgggctccaggctgaggacgaggctgattattactgcagctcatatacaaacagaaacacttggtgttcggcggcgggaccaaactgaccgtcctacgtcagcccaaggctgccccctcggtcactctccg

SEQ ID NO: 587579 - DNA, 521 bp, Homo sapiens; identical to SEQ ID NO: 538715
  misc_feature: HIJSMM301ETDDM.27.23.C01.1.454.light.4.raw

SEQ ID NO: 587580 - DNA, 490 bp, Homo sapiens; identical to SEQ ID NO: 540378
  misc_feature: HIJSMM301DM263.12.51.E07.1.454.light.4.raw

SEQ ID NO: 587581 - DNA, 494 bp, Homo sapiens; identical to SEQ ID NO: 536477
  misc_feature: HIJSMM301AWWJF.22.5.A05.1.454.light.4.raw

SEQ ID NO: 587582 - DNA, 493 bp, Homo sapiens
  misc_feature: HIJSMM301CR4NE.48.73.G07.1.454.light.4.raw
agtatacatacacgaccggtgctcgatttagctctacgctcagggcacgaccggtgctcgatttagtgacatctcgcagttctttgggggagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacga

SEQ ID NO: 587583 - DNA, 499 bp, Homo sapiens
  misc_feature: HIJSMM301BG5JW.53.33.C11.1.454.light.4.raw
cgcgtatacacacgaccggtgctcgatttagagtgagctcgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcaatagggtattcggcggaggaccaaactgaccgtccaggtcagcccaaggctgccccctggtcta

SEQ ID NO: 587584 - DNA, 494 bp, Homo sapiens; identical to SEQ ID NO: 535828
  misc_feature: HIJSMM301B5HCT.3.36.D03.1.454.light.4.raw

SEQ ID NO: 587585 - DNA, 477 bp, Homo sapiens
  misc_feature: HIJSMM301CBZK2.5.15.B04.1.454.light.4.raw
atcagacacgcacgaccggtgctcgatttagacagtatatatccgcgggggagtcagactcagtcaggacacagcatggacatgagggtccccgctcagctcctggggctcctgctgctctggctcccaggtgccaaatgtgacatccagatgacccagtctccttccaccctgtctgcatctataggagacagagtcaccatcacttgccgggccagtcagagtattagtaactggttggcctggtatcagcagaaaccaggcaaagccccaaagctccttatctctgatgcctccactttgcacggtggggtcccaccaacgttcagcggcagtggatctgggacagaattcactctcaccatcagcagcctgcagcctgatgatgctgcaacttattactgtcaacaatataacagttattggacgttcggccaagggaccaaggtggaaatcaaacgaactagtggctgcacc

SEQ ID NO: 587586 - DNA, 468 bp, Homo sapiens; identical to SEQ ID NO: 586917
  misc_feature: HIJSMM301DWGTP.49.27.C05.1.454.light.4.raw

SEQ ID NO: 587587 - DNA, 485 bp, Homo sapiens
  misc_feature: HIJSMM301DEQSH.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgctttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgacgtcctaggtcagcccaaggctgtccccccg

SEQ ID NO: 587588 - DNA, 434 bp, Homo sapiens; identical to SEQ ID NO: 535153
  misc_feature: HIJSMM301A8P8A.18.5.A05.1.454.light.4.raw

SEQ ID NO: 587589 - DNA, 420 bp, Homo sapiens; identical to SEQ ID NO: 540533
  misc_feature: HIJSMM301ANXT7.9.34.D01.1.454.light.4.raw

SEQ ID NO: 587590 - DNA, 503 bp, Homo sapiens
  misc_feature: HIJSMM301DG2Z7.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattactgcaactcacttacaacgaccgacacttgcgtattcggcggcggaccaagctgaccgtcctaggtcagcccaaggctgccccctcggt

SEQ ID NO: 587591 - DNA, 496 bp, Homo sapiens; identical to SEQ ID NO: 541772
  misc_feature: HIJSMM301D69JF.51.81.H04.1.454.light.4.raw

SEQ ID NO: 587592 - DNA, 473 bp, Homo sapiens; identical to SEQ ID NO: 538875
  misc_feature: HIJSMM301BUARO.4.75.G09.1.454.light.4.raw

SEQ ID NO: 587593 - DNA, 520 bp, Homo sapiens
  misc_feature: HIJSMM301EY1N7.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccccggacgttcggccgaagggaccgaaggtaggaaggtacaaacgaaacctagtaggcgtgcaccactctgtcttcatccttcccgtcccact

SEQ ID NO: 587594 - DNA, 487 bp, Homo sapiens
  misc_feature: HIJSMM301C2837.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactattaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatcaccttcggccaagggacacgactggagattaaacgaactgtggctgcacatctgtcttcat

SEQ ID NO: 587595 - DNA, 511 bp, Homo sapiens
  misc_feature: HIJSMM301ANIEY.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggctagaactttgctattcggcggagggaccaagttgaccgtcctagtcagcccaaggctgccccctcggtcactctgtt

SEQ ID NO: 587596 - DNA, 501 bp, Homo sapiens
  misc_feature: HIJSMM301AT4FS.12.18.B07.1.454.light.4.raw
atacgacgtacacgaccggtgctcgatttagtcgctgcgtaagggggaggaactgctcagttaggacccagagggaaccatggaagccccagctcagcttctcttcctcctgctactctggctcccagataccaccggagaaattgtgttgactcagtctccagccaccctgtctttgtctccaggggaaagagcaaccctctcctgcagggccagtcagagtgttaacagatacttagcctggtaccagcagagacctggccaggctcccaggctcctcatctatgatacattgaagagggccactggcatctcaggcagattcaatggcagtgggtctgggacagacttcactctcaccctcaccagcctagagcctgaagattttggaatttattactgtcaacagcgtagcaactggcctcccactttcggcggagggaccgaaggtggagatcaagcgaactgtggctgcaccatctgtcttcatcttcccgccta

SEQ ID NO: 587597 - DNA, 512 bp, Homo sapiens
  misc_feature: HIJSMM301C9K0V.41.30.C08.1.454.light.4.raw
tctatactatcacgaccggtgctcgatttagtctgacgtcaaagggaaaggggtggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgattaccatctcctgctctgggatcaacagcgaccttggtggttataactatgtgtcctggtaccaacaatatccaggcaaaccccccaaagtcatcatttatgatgtcggtagtcggccctccggggtctctagtcgcttctctggctccaagtctggcaacacggcctccctgaccatctctgggctccaggctgaggacgaggctgactattactgcagttcatatacaagcagcagcactggagtcttcggaactgggaccagggtcaccgtctaggtcagcccaaggccaaccccactgtcactctcg

SEQ ID NO: 587598 - DNA, 491 bp, Homo sapiens
  misc_feature: HIJSMM301E3URB.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaaggtggagatcaaacgaactgtggctgcaccatctgtcttcatcttcccgcc

SEQ ID NO: 587599 - DNA, 486 bp, Homo sapiens; identical to SEQ ID NO: 535043
  misc_feature: HIJSMM301BKILT.46.35.D02.1.454.light.4.raw

SEQ ID NO: 587600 - DNA, 513 bp, Homo sapiens
  misc_feature: HIJSMM301DYMDV.43.9.A09.1.454.light.4.raw
tgtgagtagtcacgaccggtgctcgatttagcgagacgcgcaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggccccccggacactgatttatgatacaagcaacaaactttcctggacacctgcccgattctcaggctccctccttgggggcaaagctgccctgaccctttcgggtgcgcagcctgaggatgaggctgactattactgcttgctcgcctatgatgctgctcgggttttcggcggagggaccaagttgaccgtcctaggtcagcccaaggctcgccccctcggtcactctcgtcccgccctcctcta

SEQ ID NO: 587601 - DNA, 420 bp, Homo sapiens; identical to SEQ ID NO: 541940
  misc_feature: HIJSMM301BHVHA.9.34.D01.1.454.light.4.raw

SEQ ID NO: 587602 - DNA, 506 bp, Homo sapiens; identical to SEQ ID NO: 535058
  misc_feature: HIJSMM301A1DNT.17.41.D08.1.454.light.4.raw

SEQ ID NO: 587603 - DNA, 513 bp, Homo sapiens
  misc_feature: HIJSMM301DYQ1C.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagacccccaggccagcctccacgttcactcatcgtcagcacaagcagacgtttgcctgggggtgcctgatcgcttctctgcctccatccttgggaacaaagctgccctcaccattacgggggcccagccagaggatgagtcttattattactgcatgctccatgtggggggtgccacttgggtgttcggcggagggaccaagctgaccgtccg

SEQ ID NO: 587604 - DNA, 521 bp, Homo sapiens; identical to SEQ ID NO: 538715
  misc_feature: HIJSMM301CHKD6.27.23.C01.1.454.light.4.raw

SEQ ID NO: 587605 - DNA, 491 bp, Homo sapiens; identical to SEQ ID NO: 535194
  misc_feature: HIJSMM301DREPO.26.78.H01.1.454.light.4.raw

SEQ ID NO: 587606 - DNA, 504 bp, Homo sapiens
  misc_feature: HIJSMM301CGS2Q.2.21.B10.1.454.light.4.raw
acgctcgacacacgaccggtgctcgatttagtgtcgtcgcaagagggaggggggctcagaagcagagttctggggtgtctccaccatggcctggacccctctctggctcactctcctcactctttgcataggttctgtggtttcttctgagctgactcaggaccctgctgtgtctgtggccttgggacagacagtcaggatcacatgccaaggagacagcctcagaacctattatgcaagttggtaccagcagaagccaggacaggcccctgtaattgtcatctatggaatctatggtaaaaacaaccggccctcagggatcccagaccgattctctggctcctactcaggaaacacagcttccttgaccatcactgggctcaggcggaagatgaggctgactattattgtaagtccggggacagaagtggtaattacatggtgttcggcggagggaccaagctgaccgtcctacgtcagcccaaggctgccccctcggtcact

SEQ ID NO: 587607 - DNA, 503 bp, Homo sapiens; identical to SEQ ID NO: 536834
  misc_feature: HIJSMM301EVR5K.2.35.D02.1.454.light.4.raw

SEQ ID NO: 587608 - DNA, 495 bp, Homo sapiens; identical to SEQ ID NO: 535964
  misc_feature: HIJSMM301DF3P9.16.10.A10.1.454.light.4.raw

SEQ ID NO: 587609 - DNA, 495 bp, Homo sapiens
  misc_feature: HIJSMM301ERROV.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcctgcgtcagcccaaggcctgccccctcggtcactctgttccc

SEQ ID NO: 587610 - DNA, 488 bp, Homo sapiens
  misc_feature: HIJSMM301CL2WV.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcaagcagagtggaggctgaggatgttgggctctattattgcatgcaagctctacaagtcccgctcactttcggcggagggaccaaggtggagatcaaacgtaacg

SEQ ID NO: 587611 - DNA, 489 bp, Homo sapiens; identical to SEQ ID NO: 535139
  misc_feature: HIJSMM301B1LYG.14.55.E11.1.454.light.4.raw

SEQ ID NO: 587612 - DNA, 498 bp, Homo sapiens
  misc_feature: HIJSMM301EYR6I.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggaggggaccaagctgaccgtcctaggtcagcccaaggctgccccctcggtcactctcgttcccaccctcctcgagtgcgtct

SEQ ID NO: 587613 - DNA, 471 bp, Homo sapiens
  misc_feature: HIJSMM301A51I9.41.8.A08.1.454.light.4.raw
tctatactatcacgaccggtgctcgatttagcatactctacagggggcaggagtcagacccagtcaggacacagcatggacatgagggtccccgctcagctcctggggctcctgctgctctggttcccaggttccagatgcgacatccagatgacccagtctccatcttccctgtctgcatctgtaggagacagagtcaccatcacttgtcgggcgagtcaggatattagcagctttttagcctggtatcagcagagaccagggaaagcccctaaactcctgatctatgctgcatccagtttgcaaagtggggtcccatcaaggttcagcggcagtggatctgggacagatttcactctcaccatcagcagcctgcagcctgacgattttgcaacttactattgtcaacaggctaacagtttcccgatgaccgtcggccaagggacacgactggacattaacgaactgtgg

SEQ ID NO: 587614 - DNA, 505 bp, Homo sapiens; identical to SEQ ID NO: 552248
  misc_feature: HIJSMM301EUBXA.11.67.G01.1.454.light.4.raw

SEQ ID NO: 587615 - DNA, 486 bp, Homo sapiens; identical to SEQ ID NO: 535385
  misc_feature: HIJSMM301B1PH9.19.71.G05.1.454.light.4.raw

SEQ ID NO: 587616 - DNA, 496 bp, Homo sapiens; identical to SEQ ID NO: 537925
  misc_feature: HIJSMM301B33ML.22.14.B03.1.454.light.4.raw

SEQ ID NO: 587617 - DNA, 494 bp, Homo sapiens; identical to SEQ ID NO: 536477
  misc_feature: HIJSMM301CE8N2.22.5.A05.1.454.light.4.raw

SEQ ID NO: 587618 - DNA, 493 bp, Homo sapiens; identical to SEQ ID NO: 535770
  misc_feature: HIJSMM301DD3K0.51.71.G05.1.454.light.4.raw

SEQ ID NO: 587619 - DNA, 492 bp, Homo sapiens
  misc_feature: HIJSMM301AEQC5.41.22.B11.1.454.light.4.raw
tctatactatcacgaccggtgctcgatttagacgacagctcagggggaagagctgctcagttaggacccagagggaaccatggaaaccccagcgcagcttctcttcctcctgctactctggctcccagatgccaccggagaagttgtgttgacgcagtctccggacactcttgctttgtctccaggacaaagagccaccctctcctgtacggccagtgagagtatttccagcaccttcttagcgtggtaccagcagaaacctggccaggctcccaggctcctcatctcaggtacatatgccagggccgctggcatccctgacaggttcagtggcagtgggtctgcgacagacttcactctcaccatcagtagactggagcctgaagattttgcaacatattactgtcaccagtatgcaatctcacccaggacgttcggccaagggaccagggtggaaagtacaagcgaactagtggctgcaccatctgtctt

SEQ ID NO: 587620 - DNA, 484 bp, Homo sapiens
  misc_feature: HIJSMM301BJJHD.43.53.E09.1.454.light.4.raw
tgtgagtagtcacgaccggtgctcgatttagagagagtgtgttgggtttgggaatctgcaccatgccctgggctctgctcctcctgaccctcctcactcactctgcagtgtcagtggtccaggcagggctgactcagccaccctcggtgtccaagggcttgagacagaccgccacactcacctgcactgggaacagcaacaatgttggcaaccaaggagcagcttggctgcagcagcaccagggccaccctcccaaactcctatcctacaggaataacaaccggccctcagggatctcagagagattatctgcatccaggtcaggaaacacagcctccctgaccattactggactccagcctgaggacgaggctgactattactgctcagcatgggacagcagcctcagtgcttgggtgttcggcggagggaccaagctgaccgtcctaggtcagcccaaggctgccccctcggtcactctgtt

SEQ ID NO: 587621 - DNA, 514 bp, Homo sapiens; identical to SEQ ID NO: 541418
  misc_feature: HIJSMM301AXSVF.17.33.C11.1.454.light.4.raw

SEQ ID NO: 587622 - DNA, 475 bp, Homo sapiens
  misc_feature: HIJSMM301AZN48.7.81.H04.1.454.light.4.raw
cgtgtctctacacgaccggtgctcgatttagtagtgtagattcgcgggggagtcagtctcagtcaggacacagcatggacatgagggtccccgctcagctcctggggctcctgctactctggctccgaggtgccagatgtggcatccagatgacccagtctccatcctccctgtctgcatctgtcggagacagagtcaccatcatttgccgggcaagtcagagcataagcgactctttaaattggtatcagaagaaaccaggaaaagcccctaaactcctgatctctgctgccgccagtttgcaaagtggggtcccatcaagattcagtggcagtggatctgggacagatttcactctcgccatcagtagtctgcaacctgatgattttgcaacttactactgtcaacagagttccactaccccaatcactttcggccctgggactgaagtgcatatgagagaactgtggctgca

SEQ ID NO: 587623 - DNA, 503 bp, Homo sapiens; identical to SEQ ID NO: 542388
  misc_feature: HIJSMM301C89LI.7.71.G05.1.454.light.4.raw

SEQ ID NO: 587624 - DNA, 492 bp, Homo sapiens; identical to SEQ ID NO: 537395
  misc_feature: HIJSMM301BUO7O.16.73.G07.1.454.light.4.raw

SEQ ID NO: 587625 - DNA, 441 bp, Homo sapiens; identical to SEQ ID NO: 534971
  misc_feature: HIJSMM301EPL1O.11.3.A03.1.454.light.4.raw

SEQ ID NO: 587626 - DNA, 502 bp, Homo sapiens
  misc_feature: HIJSMM301D58JL.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaattcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaactgaccgtcctaggtcagcccaa

SEQ ID NO: 587627 - DNA, 492 bp, Homo sapiens; identical to SEQ ID NO: 537666
  misc_feature: HIJSMM301CURIW.43.33.C11.1.454.light.4.raw

SEQ ID NO: 587628 - DNA, 520 bp, Homo sapiens; identical to SEQ ID NO: 546048
  misc_feature: HIJSMM301DZKSL.27.23.C01.1.454.light.4.raw

SEQ ID NO: 587629 - DNA, 508 bp, Homo sapiens
  misc_feature: HIJSMM301E22ES.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcggactgggaccaaggtcaccgtcctaggtcagcccaacggccaaccccactgtcact

SEQ ID NO: 587630 - DNA, 498 bp, Homo sapiens
  misc_feature: HIJSMM301CTVQH.43.34.D01.1.454.light.4.raw
tgtgagtagtcacgaccggtgctcgatttagatcgtctgtgttgggtttgggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaacccta

SEQ ID NO: 587631 - DNA, 521 bp, Homo sapiens
  misc_feature: HIJSMM301BDL4O.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggccgtccgggggccactttcggtcccgtcgggaccgaaacgtaggagtatcaaacgaactagtggcgtgcaccactctcgttcttcta

SEQ ID NO: 587632 - DNA, 503 bp, Homo sapiens; identical to SEQ ID NO: 545379
  misc_feature: HIJSMM301EDCVQ.9.53.E09.1.454.light.4.raw

SEQ ID NO: 587633 - DNA, 481 bp, Homo sapiens; identical to SEQ ID NO: 535993
  misc_feature: HIJSMM301A7HY6.21.25.C03.1.454.light.4.raw

SEQ ID NO: 587634 - DNA, 500 bp, Homo sapiens
  misc_feature: HIJSMM301CCO47.26.26.C04.1.454.light.4.raw
agactatactcacgaccggtgctcgatttagtctagcgactttgggtttggggctgatcaggactcctcagttcaccttctcacaatgaggctccctgctcagctcctggggctgctaatgctctgggtcccagggtccagtggggatgttgtgatgactcagtctccgctctccctgcccgtcacccttggacaggcggcctccatctcctgcaggtctagtcagagcctcgtacacagtgatgggaacaccgccttgaactggattcagcagaggccaggccaacctccgaggcgcctaatttataagatttctaatcgggattccggggtcccagacagattcagcggcagtgggtcaggcactgatttcacgctgaagatcagcagggtggaggctgaggatgttgcggtttattactgcctgcagagtattcactggccgtggacgttcggccaagggaccaaggtggaaatacaaacgaaactgtggctgcacc

SEQ ID NO: 587635 - DNA, 494 bp, Homo sapiens; identical to SEQ ID NO: 536477
  misc_feature: HIJSMM301DVT8Y.22.5.A05.1.454.light.4.raw

SEQ ID NO: 587636 - DNA, 416 bp, Homo sapiens; identical to SEQ ID NO: 535308
  misc_feature: HIJSMM301CZKAU.16.46.E02.1.454.light.4.raw

SEQ ID NO: 587637 - DNA, 488 bp, Homo sapiens
  misc_feature: HIJSMM301BYTYK.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactgaaaatcagccgggtgggggctgaggatgttggcatttattactgcatgcaggctatacaccttcctgccacttttggccagggaccaagctggagatcaggcgtaacg

SEQ ID NO: 587638 - DNA, 489 bp, Homo sapiens
  misc_feature: HIJSMM301C3Q41.48.25.C03.1.454.light.4.raw
agtatacatacacgaccggtgctcgatttagtagtgtagatttgggtttgggggctgtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctccg

SEQ ID NO: 587639 - DNA, 505 bp, Homo sapiens; identical to SEQ ID NO: 535503
  misc_feature: HIJSMM301EZ0TE.8.28.C06.1.454.light.4.raw

SEQ ID NO: 587640 - DNA, 502 bp, Homo sapiens; identical to SEQ ID NO: 543936
  misc_feature: HIJSMM301EFQOY.15.1.A01.1.454.light.4.raw

SEQ ID NO: 587641 - DNA, 484 bp, Homo sapiens; identical to SEQ ID NO: 535400
  misc_feature: HIJSMM301A4Q5A.46.26.C04.1.454.light.4.raw

SEQ ID NO: 587642 - DNA, 518 bp, Homo sapiens
  misc_feature: HIJSMM301AOWPE.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggcctgccccctggtcactctgttcccgccctcctcacg

SEQ ID NO: 587643 - DNA, 494 bp, Homo sapiens; identical to SEQ ID NO: 549057
  misc_feature: HIJSMM301C9CQZ.10.33.C11.1.454.light.4.raw

SEQ ID NO: 587644 - DNA, 497 bp, Homo sapiens
  misc_feature: HIJSMM301BZHPU.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccggtcctaggtcagcccaagaccaacccactgt

SEQ ID NO: 587645 - DNA, 513 bp, Homo sapiens; identical to SEQ ID NO: 561267
  misc_feature: HIJSMM301C0D05.22.36.D03.1.454.light.4.raw

SEQ ID NO: 587646 - DNA, 448 bp, Homo sapiens; identical to SEQ ID NO: 551497
  misc_feature: HIJSMM301B5H6P.18.9.A09.1.454.light.4.raw

SEQ ID NO: 587647 - DNA, 492 bp, Homo sapiens
  misc_feature: HIJSMM301CSA58.19.71.G05.1.454.light.4.raw
tactctcgtgcacgaccggtgctcgatttagtgtcgtcgcaagagagaggggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcggtggacgttcggccaagggaccaaggtggatatcagacgaactgtgg

SEQ ID NO: 587648 - DNA, 512 bp, Homo sapiens
  misc_feature: HIJSMM301BA2PV.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcgagggaccaagctgaccgtcttaagtcagcccaaggctgccccctcggtcactctgtcccaccctcct

SEQ ID NO: 587649 - DNA, 493 bp, Homo sapiens; identical to SEQ ID NO: 556456
  misc_feature: HIJSMM301DRC2R.49.41.D08.1.454.light.4.raw

SEQ ID NO: 587650 - DNA, 484 bp, Homo sapiens; identical to SEQ ID NO: 535400
  misc_feature: HIJSMM301ALQF9.46.26.C04.1.454.light.4.raw

SEQ ID NO: 587651 - DNA, 500 bp, Homo sapiens
  misc_feature: HIJSMM301CJL05.40.57.F02.1.454.light.4.raw
  modified_base (330)..(330): a, c, t, g, unknown or other
tctagcgactcacgaccggtgctcgatttagctcgatatagttgggtttggggtggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcnctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcggcccaaggctccg

SEQ ID NO: 587652 - DNA, 504 bp, Homo sapiens
  misc_feature: HIJSMM301AK8LX.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttctaggatgggattacagcctacatgctcggctgttcggcggagggaccaactgaccgtcttaggtcagcccaaggctcgtccccccg

SEQ ID NO: 587653 - DNA, 491 bp, Homo sapiens
  misc_feature: HIJSMM301AZO0T.47.36.D03.1.454.light.4.raw
agctcacgtacacgaccggtgctcgatttagctgcgtcacgatctctcttgggggcaggagtcagacccagtcaggacacagcatggacatgagggtccccgctcagctcctggggctcctgttgctctggttcccaggttccagatgcgacatccagatgacccagtctccatcttctgtgtctgcttctgtaggagacagagtcaccatcacttgtcgggcgagtcagggtattagcaactggttagcctggtatcaaacagaaaccagggaaagcccctaacctcctcatctctactgcatccactttgcaaagtgggtcccatcaaggttcagcggcaggtggatctgggacagatttcactctcactatcagcagcctgcagcctgaagattttggaacttattattgtcaacagggtaacagtttcccgcttcgaccttcggcggagggaccaaggtggagatgaaagaactgtggctgcaccat

SEQ ID NO: 587654 - DNA, 498 bp, Homo sapiens
  misc_feature: HIJSMM301D39Y4.13.42.D09.1.454.light.4.raw
tcacgtactacacgaccggtgctcgatttagacacatacgcagggaaaggggagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctcggacgtcggtccaagggaccgaaggtaggaagtacaaacgaactagtaggcgtgcaccactctgtt

SEQ ID NO: 587655 - DNA, 507 bp, Homo sapiens
  misc_feature: HIJSMM301E3VUL.43.16.B05.1.454.light.4.raw
  modified_base (453)..(453): a, c, t, g, unknown or other
tgtgagtagtcacgaccggtgctcgatttagagctcacgtaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaacatcacttgccgggcaagtcagactatcaacacccatttaaattggtatcagcagaaacgagggaaagcccctaaactcctgatttatgttgcatccactttacaaactaggggtcccatcaaggttcagtggcagtggatctggggcagatttcactctcaacatcggcagtgttcaacctgaagattttgcgacttattattgtcaacagagtcacagtttcccgtacacttttggtccaggggaccgaacggntggagagcaaacgaaactgttggctgcaccactctgtcttctatctttcccccg

SEQ ID NO: 587656 - DNA, 508 bp, Homo sapiens
  misc_feature: HIJSMM301B63CQ.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctgggaccaaaattgagatcaaacgaactgtggctgcaccatctgtcttcatcttcccgccactc

SEQ ID NO: 587657 - DNA, 500 bp, Homo sapiens; identical to SEQ ID NO: 541423
  misc_feature: HIJSMM301AGAAL.10.71.G05.1.454.light.4.raw

SEQ ID NO: 587658 - DNA, 518 bp, Homo sapiens
  misc_feature: HIJSMM301A2OK4.26.72.G06.1.454.light.4.raw
agactatactcacgaccggtgctcgatttagctacgactgcaagggaaaggggcagcaagatggtgttgcagacccaggtcttcatttctctgttgctctggatctctggtgcccgcggggacatcgtgatgacccagtctccagactccctggctgtgtctctgggcgagagggccaccatcaactgcaagtccagccagagtgttttatacaggtccgacaataagaactacttagcttggtaccagcagaaaccaggacagcctcctaatctactcatttactgggcctctacccgggaatccggggtctctggccgattcagtgccagcgggtctgggacagagttcactctcaccatcagcagcctgcaggctgaagatgtggcagttttattactgtcagcaattattttcgtgctccgtacacttttggccagggggacccagggtggagatcagactgatattaacagcgaaaagagtatttttgttaaaggggaaagtaatgaagttaa

SEQ ID NO: 587659 - DNA, 494 bp, Homo sapiens; identical to SEQ ID NO: 550130
  misc_feature: HIJSMM301D8MWW.12.38.D05.1.454.light.4.raw

SEQ ID NO: 587660 - DNA, 496 bp, Homo sapiens; identical to SEQ ID NO: 538149
  misc_feature: HIJSMM301B57UZ.13.67.G01.1.454.light.4.raw

SEQ ID NO: 587661 - DNA, 471 bp, Homo sapiens; identical to SEQ ID NO: 537461
  misc_feature: HIJSMM301C2AWI.7.81.H04.1.454.light.4.raw

SEQ ID NO: 587662 - DNA, 494 bp, Homo sapiens; identical to SEQ ID NO: 534994
  misc_feature: HIJSMM301D7EXI.27.78.H01.1.454.light.4.raw

SEQ ID NO: 587663 - DNA, 485 bp, Homo sapiens; identical to SEQ ID NO: 572175
  misc_feature: HIJSMM301BPJ55.12.33.C11.1.454.light.4.raw

SEQ ID NO: 587664 - DNA, 503 bp, Homo sapiens
  misc_feature: HIJSMM301CFOQJ.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggcctccgggggccactttcggccctgggaccaaagtggatatcaacgaactgtgcgtgcacatctgtctt

SEQ ID NO: 587665 - DNA, 484 bp, Homo sapiens
  misc_feature: HIJSMM301BQSPB.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtccaagaacttttggccaggggccaagctggagatcaaacgaactgtggctgcaccat

SEQ ID NO: 587666 - DNA, 485 bp, Homo sapiens; identical to SEQ ID NO: 550410
  misc_feature: HIJSMM301EPSOI.14.53.E09.1.454.light.4.raw

SEQ ID NO: 587667 - DNA, 507 bp, Homo sapiens; identical to SEQ ID NO: 564948
  misc_feature: HIJSMM301DFJ0A.19.78.H01.1.454.light.4.raw

SEQ ID NO: 587668 - DNA, 508 bp, Homo sapiens; identical to SEQ ID NO: 552440
  misc_feature: HIJSMM301A2ML8.5.24.C02.1.454.light.4.raw

SEQ ID NO: 587669 - DNA, 511 bp, Homo sapiens
  misc_feature: HIJSMM301B8F6L.9.37.D04.1.454.light.4.raw
tgatacgtctcacgaccggtgctcgatttagtagcatactgttgggtttggggggtgtggtggtgcctcagccatggcctggaccgttctcctcctcggcctcctctctcactgcacaggctctgtgacctcctacgtgctgactcagccaccctcggtgtcagtggccccaggaaagacggccaccattacgtgtgggggatacaacattggaagtaaaagtgttcactggtaccagcagaagccaggccaggcccctgtgttggtcgtctatgatgatacagaccggccctcagggatccctgagcgattctctggctccaattctggtgacacggccaccctgatcatcagcagggtcgaggtcgaggatgaggccgactattactgtcaggtgtgggatagtggtactgatcattgggtgttcggcggagggaccaagctgaccgtcctaggtcagcccaaggctgccccctcggtcactctgttcccgccctcctcagacgtatca

SEQ ID NO: 587670 - DNA, 486 bp, Homo sapiens
  misc_feature: HIJSMM301C7LMT.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctgtagggccggtcagagtattagcatcaacttagcctggtaccagcagagacctgggcaggctcccaggctcctcatctatgatgcgtccaccagggccactggtttcccagccaggttcagtggcagtgcgtctgggacagagttcactctcaccatcaacagcctgcagtctgaagattttgcagtttattactgtcagcagtatcataactggccgctcaccttcggccaaggggacacgactggagattaaacgaactgtggctgcaccat

SEQ ID NO: 587671 - DNA, 486 bp, Homo sapiens; identical to SEQ ID NO: 535043
  misc_feature: HIJSMM301C3JNQ.46.35.D02.1.454.light.4.raw

SEQ ID NO: 587672 - DNA, 485 bp, Homo sapiens; identical to SEQ ID NO: 535501
  misc_feature: HIJSMM301AI48A.3.10.A10.1.454.light.4.raw

SEQ ID NO: 587673 - DNA, 476 bp, Homo sapiens
  misc_feature: HIJSMM301CNQW0.4.63.F08.1.454.light.4.raw
agcactgtagcacgaccggtgctcgatttagcgatcgtataaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgtacaagtcagagcattaacatctatttaaattggtatcagcagcaatcagggaaagcccctaaactcctgatctatgatggatccactttggaacatggggtcccttcaaggttcagtggcagtggatctgggacagagttcactctcaccatcagccgtctgcaacctgaagattttgcaacttactactgtcaacagagttacaatctcccgctcactttcggcggagggacgaaggtggagatcaaacgaactgtggctgcacc

SEQ ID NO: 587674 - DNA, 495 bp, Homo sapiens
  misc_feature: HIJSMM301BFZ43.51.81.H04.1.454.light.4.raw
  modified_base (483)..(483): a, c, t, g, unknown or other
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtcctgggtcagcccaaggccaacccnctgtcactctcg

SEQ ID NO: 587675 - DNA, 496 bp, Homo sapiens
  misc_feature: HIJSMM301DBDT0.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacggactgggagattaaacgaactgtggctgcaccatctgtctt

SEQ ID NO: 587676 - DNA, 495 bp, Homo sapiens
  misc_feature: HIJSMM301CIHHQ.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacagacttcactctcaccatcagcagcctagagcctgaagtattttgctagtttattactgtcagcagcgtagcaactggcctctcaccttcggcggagggaccaagggtggagatacaaacgaactgtggctgcaccatctgtt

SEQ ID NO: 587677 - DNA, 465 bp, Homo sapiens; identical to SEQ ID NO: 538589
  misc_feature: HIJSMM301C48SY.12.39.D06.1.454.light.4.raw

SEQ ID NO: 587678 - DNA, 496 bp, Homo sapiens
  misc_feature: HIJSMM301AXK3D.47.64.F09.1.454.light.4.raw
agctcacgtacacgaccggtgctcgatttagcgcgtatacaagggggaggaactgctcagttaggacccagagggaaccatggaagccccagctcagcttctcttcctcctgctactctggctcccagataccatcggagaagttgtgttgacacagtctccagccaccctgtctttgtctccaggggaaagagccaccctctcctgcagggccagtcagaatattcactcctacttagcctggtaccaacagaaacctggtcaggctcccaggctcctcatctatgatgcatccaacagggccactggcatcccagacaggttcagtggcagtgggtctggggacagacttcactctcaccatcagcagcctagagcctgaagactttggactttattactgtcagcagcgtgagttctggcctccgctcactttcggcggaggggaccagggtggaggatcaaacgaactgtggctgcaccatctgtcttcatt

SEQ ID NO: 587679 - DNA, 505 bp, Homo sapiens
  misc_feature: HIJSMM301DY53G.48.57.F02.1.454.light.4.raw
agtatacatacacgaccggtgctcgatttagctcgatatagttgggtttgggggaggaactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaaacgaactgtggctgcaccatctgtcttcatcttccccg

SEQ ID NO: 587680 - DNA, 499 bp, Homo sapiens; identical to SEQ ID NO: 547044
  misc_feature: HIJSMM301B0Q1P.43.71.G05.1.454.light.4.raw

SEQ ID NO: 587681 - DNA, 509 bp, Homo sapiens; identical to SEQ ID NO: 541829
  misc_feature: HIJSMM301B0OVU.17.28.C06.1.454.light.4.raw

SEQ ID NO: 587682 - DNA, 486 bp, Homo sapiens; identical to SEQ ID NO: 535043
  misc_feature: HIJSMM301BZQV3.46.35.D02.1.454.light.4.raw

SEQ ID NO: 587683 - DNA, 502 bp, Homo sapiens; identical to SEQ ID NO: 543936
  misc_feature: HIJSMM301ASBG1.15.1.A01.1.454.light.4.raw

SEQ ID NO: 587684 - DNA, 561 bp, Homo sapiens
  misc_feature: HIJSMM301CRO2Q.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtaacttcacccccggacgttcggtccgaacgggaccgaaggtacgggaaggtacgtaaaaccggaaacctaagtggcgttcggcaccgaactcctggttcctttcctattacctttcccggtccctactccttcgtacgttaa

SEQ ID NO: 587685 - DNA, 502 bp, Homo sapiens; identical to SEQ ID NO: 537363
  misc_feature: HIJSMM301BH9FM.18.23.C01.1.454.light.4.raw

SEQ ID NO: 587686 - DNA, 506 bp, Homo sapiens
  misc_feature: HIJSMM301CKOBU.19.85.H08.1.454.light.4.raw
tactctcgtgcacgaccggtgctcgatttagtatcactcagtcgcggggtccaaacagagcttcagcaagcatagtgggaatctgcaccatgccctgggctctgctcctcctgaccctcctcactcactctgcagtgtcagtggtccaggcaggactgactcagccaccctcggtgtccggggcctgggacaggccgccacagtcacctgcaccgggaacaccaacaatgtcggcgaccagggagccgcttggctgcagcaacgccagggccaccctcccaaactcctgtcgtacaggaatgacaaccggccctcaaacatttcagagagattttctacctccaggacaacaaaatacagcctctctgaccattactggtctccagcctgacgacgaggctgactactactgctcagcctgggacaccagcctcgctgcttggcttttcggcggagggaccaagctgaccgtcctgggtcagcccaaggctgccccctcggtccta

SEQ ID NO: 587687 - DNA, 518 bp, Homo sapiens; identical to SEQ ID NO: 567367
  misc_feature: HIJSMM301C7S2T.14.70.G04.1.454.light.4.raw

SEQ ID NO: 587688 - DNA, 454 bp, Homo sapiens; identical to SEQ ID NO: 535005
  misc_feature: HIJSMM301A55Y6.19.86.H09.1.454.light.4.raw

SEQ ID NO: 587689 - DNA, 488 bp, Homo sapiens; identical to SEQ ID NO: 535861
  misc_feature: HIJSMM301CE0UD.14.55.E11.1.454.light.4.raw

SEQ ID NO: 587690 - DNA, 497 bp, Homo sapiens
  misc_feature: HIJSMM301CE8TM.19.71.G05.1.454.light.4.raw
tactctcgtgcacgaccggtgctcgatttagtgtcgtcgcaagagagaggggggaggtacaacaggcaggcaggggcggcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggccaagggaccaaggtggatatcagacgaactgtggctgca

SEQ ID NO: 587691 - DNA, 491 bp, Homo sapiens
  misc_feature: HIJSMM301BMMEN.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttacacttttggccaggggaccaagctggagatcaaacgaactat

SEQ ID NO: 587692 - DNA, 504 bp, Homo sapiens; identical to SEQ ID NO: 554247
  misc_feature: HIJSMM301BKPNT.19.78.H01.1.454.light.4.raw

SEQ ID NO: 587693 - DNA, 505 bp, Homo sapiens; identical to SEQ ID NO: 569910
  misc_feature: HIJSMM301BT9MM.19.78.H01.1.454.light.4.raw

SEQ ID NO: 587694 - DNA, 502 bp, Homo sapiens; identical to SEQ ID NO: 541971
  misc_feature: HIJSMM301AQGUE.4.39.D06.1.454.light.4.raw

SEQ ID NO: 587695 - DNA, 496 bp, Homo sapiens; identical to SEQ ID NO: 541772
  misc_feature: HIJSMM301EMLAP.51.81.H04.1.454.light.4.raw

SEQ ID NO: 587696 - DNA, 502 bp, Homo sapiens
  misc_feature: HIJSMM301DTM4W.2.34.D01.1.454.light.4.raw
acgctcgacacacgaccggtgctcgatttagatcgtctgtgttgggtttgggggctttgcctgggctctgctcctcctcaccctcctcactcagggcacagggtcctgggcccagtctgccctgactcagcccccctccgcgtccgggtctcctggacagtcagtcaccatctcctgcactggaatcagcagtgacctgagtccttataactatgtctcctggtaccaacaacacccaggcaaagcccccaaactcattatttatgaagtcactaagcggccctcaggggtccctgatcgcttctctggctccaagtctggcgagacggcctccctgaccgtctctgggctccaggctgaagatgaggctgattattactgcagctcatatgcaggcagcaaacaatgtggcattcggcggagggaccaagctgaccgtcctgggtcagcccaaggctcgccccctcggtcactctcgttcccaccctcctctgtcgagcgt

SEQ ID NO: 587697 - DNA, 505 bp, Homo sapiens
  misc_feature: HIJSMM301EQN5Z.5.59.F04.1.454.light.4.raw
atcagacacgcacgaccggtgctcgatttagtacacacacttagggattgggggctctggagaagagctgctcagttaggacccagagggaaccatggaaaccccagcgcagcttctcttcctcctgctactctggctcccagatgccaccggaaagactgtgttgacgcagtctccaggcaccctgtctttgtctccaggggaaagagccaccctctcctgcagggccagtcagaatgttaccaacaggttcgtagcctggtaccagcagaaacctggccaggttcccagcctcctcatctatggtatatccaccagggccactggcatcccagacaggttcagtggcagcgggtctgggacagacttcactctcaccatcagcagactggagcctgaagattttgcagtgtattactgtcagcagtatggtagctcacggacgttggtccaagggaccgaacggtaggaaatacaaacgaaactacgtggcgtgcaccactct

SEQ ID NO: 587698 - DNA, 499 bp, Homo sapiens
  misc_feature: HIJSMM301B8Q9B.48.59.F04.1.454.light.4.raw
agtatacatacacgaccggtgctcgatttagtacacacacttagggattggggagagaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtctt

SEQ ID NO: 587699 - DNA, 495 bp, Homo sapiens; identical to SEQ ID NO: 535486
  misc_feature: HIJSMM301AKU5G.26.72.G06.1.454.light.4.raw

SEQ ID NO: 587700 - DNA, 490 bp, Homo sapiens
  misc_feature: HIJSMM301AFIAV.22.86.H09.1.454.light.4.raw
acatacgcgtcacgaccggtgctcgatttagtgctatagacttgggtttgggggctttgcctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccgaagctgaccgtcctaggtcagcccaaggctgccccctcggtcactctgttcccaccctcctc

SEQ ID NO: 587701 - DNA, 501 bp, Homo sapiens
  misc_feature: HIJSMM301BU0SC.41.45.E01.1.454.light.4.raw
tctatactatcacgaccggtgctcgatttagtgagtcagtaagggaaagggggtgtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaaggctgaccgtcctaggtcagcccaaggctgccccctcggtcactc

SEQ ID NO: 587702 - DNA, 521 bp, Homo sapiens; identical to SEQ ID NO: 539470
  misc_feature: HIJSMM301DLMM1.27.23.C01.1.454.light.4.raw

SEQ ID NO: 587703 - DNA, 464 bp, Homo sapiens; identical to SEQ ID NO: 536640
  misc_feature: HIJSMM301C25EI.26.78.H01.1.454.light.4.raw

SEQ ID NO: 587704 - DNA, 475 bp, Homo sapiens
  misc_feature: HIJSMM301A8ZFY.4.75.G09.1.454.light.4.raw
agcactgtagcacgaccggtgctcgatttagtatagacatcaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcagctgctctggagataaattgggggataagtatgtttgttggtatcagcagaagccaggccagtcccctgtgctggtcatctattatgataccaagcggccctcagggatccctgagcgattctctggctccaactctgggaacacagccactctgaccatcagcgggacccaggctatggatgaggctgactattactgtcaggcgtgggacagcagcactccctatgtcttcggcacgtgggaccaaggtccaccgtcctaggtcagaccccg

SEQ ID NO: 587705 - DNA, 505 bp, Homo sapiens; identical to SEQ ID NO: 586937
  misc_feature: HIJSMM301AXAM1.9.53.E09.1.454.light.4.raw

SEQ ID NO: 587706 - DNA, 490 bp, Homo sapiens; identical to SEQ ID NO: 543909
  misc_feature: HIJSMM301ATGLA.14.55.E11.1.454.light.4.raw

SEQ ID NO: 587707 - DNA, 492 bp, Homo sapiens; identical to SEQ ID NO: 580589
  misc_feature: HIJSMM301C88TF.14.36.D03.1.454.light.4.raw

SEQ ID NO: 587708 - DNA, 491 bp, Homo sapiens; identical to SEQ ID NO: 535194
  misc_feature: HIJSMM301CJ6W0.26.78.H01.1.454.light.4.raw

SEQ ID NO: 587709 - DNA, 492 bp, Homo sapiens; identical to SEQ ID NO: 534967
  misc_feature: HIJSMM301EUN9Z.47.64.F09.1.454.light.4.raw

SEQ ID NO: 587710 - DNA, 487 bp, Homo sapiens; identical to SEQ ID NO: 558047
  misc_feature: HIJSMM301CFHQK.4.26.C04.1.454.light.4.raw

SEQ ID NO: 587711 - DNA, 496 bp, Homo sapiens
  misc_feature: HIJSMM301AUEVR.13.5.A05.1.454.light.4.raw
tcacgtactacacgaccggtgctcgatttagatagatagacaggggacacaagctcagctgtaactgtgccttgactgatcaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcggcctccggggtcctaacaggttcagtggcagtggatcaggcacagattttacactgaaaatcagcagagtggaggctgaggatgttggggtttattactgcatgcaagctctacaacctctgcggactttcggtcccgtcggtaccgaaacgg

SEQ ID NO: 587712 - DNA, 500 bp, Homo sapiens
  misc_feature: HIJSMM301CP3H2.4.57.F02.1.454.light.4.raw
agcactgtagcacgaccggtgctcgatttagctcgatatagttgggtttggggctgggcctaaggaagcagcactggtggtgcctcagccatggcctggaccgttctcctcctcggcctcctctctcactgcacaggctctgtgacctcatatgtgctgactcagccacctcagtgtcagtggccccagggcagacggccaggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacatggccaccctgaccatcagcagggtcgaagccgggatgaggccgactattactgtcaggtgtgggatagtagtggtgatcatccatacgtcttcggaactgggaccaaggtctccgtcctacgtcagcccaaggccaactccactgtcta

SEQ ID NO: 587713 - DNA, 477 bp, Homo sapiens
  misc_feature: HIJSMM301BD8MY.13.4.A04.1.454.light.4.raw
tcacgtactacacgaccggtgctcgatttagagtagtgatcagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattaacaactatttaaattggtatcagcagaaaccaggtaaagcccctaagctcctgatctatgttgcatccactttgcaaagtggggtcccatcaaggttcagcggcagtggatctgggacagaattcactctcacaatcagcagcctgcagcctgaagattttgcaacttattactgtcaacagcttaatagttacccgctcagtttcggcggagggaccaaggtggagatcaaacgaactgtggctgca

SEQ ID NO: 587714 - DNA, 472 bp, Homo sapiens
  misc_feature: HIJSMM301CRSOG.16.73.G07.1.454.light.4.raw
tgtactactccacgaccggtgctcgatttagctctacgctcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatataactccaacaataagagctacttagcttggtaccagcacaaatcaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcaacaatattataataatccatttaatttcggcggagggaccaaggtggagatcaaacgaactgtggctgcaccatc

SEQ ID NO: 587715 - DNA, 526 bp, Homo sapiens
  misc_feature: HIJSMM301BGR7A.27.23.C01.1.454.light.4.raw
agcgtcgtctcacgaccggtgctcgatttagtacacgtgattagggattggggggggtctcaggaggcagcgctctcgggacgtctccaccatggcctgggctctgctacttcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgtttcggcggtagggaccaggctgaccgtcctaggtcagcccaaggctgccccctcggtcactctgttcccgccctcc

SEQ ID NO: 587716 - DNA, 494 bp, Homo sapiens; identical to SEQ ID NO: 548501
  misc_feature: HIJSMM301B3UQ2.52.54.E10.1.454.light.4.raw

SEQ ID NO: 587717 - DNA, 490 bp, Homo sapiens
  misc_feature: HIJSMM301CLK41.41.2.A02.1.454.light.4.raw
tctatactatcacgaccggtgctcgatttagactcatctacagggggagtcagtcccaaccaggacacagcatggacatgagggtccctgctcagctcctggggctcctgctgctctggctctcaggcgccagatgtgacatccagatgacccagtctccatcctccctgtctgcatctttaggagacagagtcaccatctcttgtcaggcgaatgaggacattaacgtttatttaaattggtatcggcagagaccagggaaagcccctgagctcctgatttatgataaatcgaatttgaatccagggtcccatctaggttccgtggaagtggatctgggacagactttactctcaccattagcagcctggagcctgaagatattgcaacatattactgtcaacagtctcatggtcctcccccttagtttcggcggagggaccaaggttgagatcaaacgactgtggctgcaccatctgtcttcattccc

SEQ ID NO: 587718 - DNA, 491 bp, Homo sapiens
  misc_feature: HIJSMM301BIJKW.48.75.G09.1.454.light.4.raw
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattactgcatgcaaggtatcttcctcccatacacttttggcccggggaccaaggtggatctcaaaagaactgtggctgcaccta

SEQ ID NO: 587719 - DNA, 486 bp, Homo sapiens; identical to SEQ ID NO: 535043
  misc_feature: HIJSMM301C09JV.46.35.D02.1.454.light.4.raw

SEQ ID NO: 587720 - DNA, 520 bp, Homo sapiens
  misc_feature: HIJSMM301DKSVY.5.27.C05.1.454.light.4.raw
atcagacacgcacgaccggtgctcgatttagacgcgatcgaagggtttggggctgggcctaaggaagcagcactggtggtgcctcagccatggcctggacctttctcctcctcggcctcctctctcactgcacaggctctgtgacctcctatgtgctgactcagccaccctcagtgtcagtggccccaggaaagacggccgggatcacctgtgggggaaacaacattggaggtaaaagtgtgaactggtaccagcagaagccaggccaggcccctgtactggtcatctattatgataccgaccggccctcagggatccctgagcgattctctggctccaagtctgggaacacggccaccctgaccatcagcagggtcgaagccggggatgaggccgactattactgtcaggtgtggaatggtgattatgattatgtcttcggaactgggaccaaggtcaccgtcctaggtcagcccaaggccaaccccactgtcactctgttcccgccctccctccgtgt

SEQ ID NO: 587721 - DNA, 490 bp, Homo sapiens
  misc_feature: HIJSMM301DBKDK.22.65.F10.1.454.light.4.raw
  modified_base (488)..(488): a, c, t, g, unknown or other
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgcccccccgatccaccttcggccaagggacacgactggagataaacgaactgtggctgcaccatctgtcttnat

SEQ ID NO: 587722 - DNA, 515 bp, Homo sapiens
  misc_feature: HIJSMM301AV2NK.48.57.F02.1.454.light.4.raw
agtatacatacacgaccggtgctcgatttagctcgatatagttgggtttggggagcttcagctgtggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcta

SEQ ID NO: 587723 - DNA, 492 bp, Homo sapiens; identical to SEQ ID NO: 537395
  misc_feature: HIJSMM301BRX2T.16.73.G07.1.454.light.4.raw

SEQ ID NO: 587724 - DNA, 512 bp, Homo sapiens; identical to SEQ ID NO: 541300
  misc_feature: HIJSMM301EP2I8.17.33.C11.1.454.light.4.raw

SEQ ID NO: 587725 - DNA, 503 bp, Homo sapiens
  misc_feature: HIJSMM301C44DU.41.71.G05.1.454.light.4.raw
tctatactatcacgaccggtgctcgatttagtgtcgtcgcaagagagaggggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagccctgcagcctgaagatatcgcaacttattactgtcaacaatataacacttattcaggggcattcggccaagggaccaaggtaggaaattaaacgaactgtggctgcaccatctgtcttcatcttcccg

SEQ ID NO: 587726 - DNA, 368 bp, Homo sapiens
  misc_feature: HIJSMM301BJWBJ.41.34.D01.1.454.light.4.raw
tctatactatcacgaccggtgctcgatttagatcgtctgtgttgggtttggggggagtcagacccagtcaggacacagcatggacatgagggtccccgctcagctcctggggctcctgctgctctggctcccaggtgccaaatgtgacatccagatgacccagtctccctccattctgtctgcatctgtcggagacagagtcaccatcacttgccgggccagtcagagtattgcacacgcgttggcctggtatcagcagaaaccagggaaagcccctaaattcctgatctatcaggcatctaatttggaaagtggggtcccatcaaggtttagcggcagtggatctgggacagaattcactctcacga

SEQ ID NO: 587727 - DNA, 487 bp, Homo sapiens
  misc_feature: HIJSMM301DB2GC.17.26.C04.1.454.light.4.raw
cgtagactagcacgaccggtgctcgatttagtctagcgactttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaaagctcctgatctttgctgcatccagtttgcaaagtggggtcccttcaaggttcagtggcagtggatctgggacagatttcactctcaccatcagcagtctgcaacctgaagattttgcaacttaactactgtcaacagagttacaatacccctcggctcaaccttgtcgggagggaccgaaggtaggaggatacaaaacgaaacaagtgggctg

SEQ ID NO: 587728 - DNA, 523 bp, Homo sapiens
  misc_feature: HIJSMM301EEMZC.9.12.B01.1.454.light.4.raw
  modified_base (429)..(429): a, c, t, g, unknown or other
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttatactgtcaacagtttttcncgggcgttcggccgaagggacccgaaaggtacgggaaatacgtaaaacgaaactacggttggacgtgcgaccatctgtctttcatctttccccg

SEQ ID NO: 587729 - DNA, 515 bp, Homo sapiens
  misc_feature: HIJSMM301EOF2E.18.59.F04.1.454.light.4.raw
  modified_base (438)..(438): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcataatcggccctcaggggtttctaatcgcttctctggctccaagtctggcaacacggcctccctgaccatctctgggctccaggctgaggacgaggctgattattactgcagctcatatacaagcacgcanctactcaagtcttcgtaacgtacggtacggaacgtacgtaccgtccctacgttcgacgaccaaccggaccgacccaa

SEQ ID NO: 587730 - DNA, 499 bp, Homo sapiens
  misc_feature: HIJSMM301BP9YH.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctcttttcaagatattcggcggagggaccaggctgaccgtcctgagtcagcccaaggctgg

SEQ ID NO: 587731 - DNA, 496 bp, Homo sapiens; identical to SEQ ID NO: 536690
  misc_feature: HIJSMM301B7CXP.40.23.C01.1.454.light.4.raw

SEQ ID NO: 587732 - DNA, 494 bp, Homo sapiens; identical to SEQ ID NO: 541400
  misc_feature: HIJSMM301DF88J.51.71.G05.1.454.light.4.raw

SEQ ID NO: 587733 - DNA, 491 bp, Homo sapiens; identical to SEQ ID NO: 538021
  misc_feature: HIJSMM301EWLUN.3.72.G06.1.454.light.4.raw

SEQ ID NO: 587734 - DNA, 503 bp, Homo sapiens; identical to SEQ ID NO: 537216
  misc_feature: HIJSMM301CEHCM.3.70.G04.1.454.light.4.raw

SEQ ID NO: 587735 - DNA, 494 bp, Homo sapiens
  misc_feature: HIJSMM301EMTH8.51.81.H04.1.454.light.4.raw
cgatcgtatacacgaccggtgctcgatttagtagtgtagattcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatgcattgccaaaccgatatgcttattggtaccagcagaagccgggccaggcccctgtgttggtgatgtataaagacactgagaggccctcagggatccctgagcgattctctggctccaggtcagggacaacggtcacattggccatcagtggagtccaggcagaggacgaggctgactattattgtcaatcaacagacaccattggtacttatgtcttcggaactgcgaccaaggtcaccgtctgggtcagcccaaggccaacccactgtcactctcg

SEQ ID NO: 587736 - DNA, 499 bp, Homo sapiens
  misc_feature: HIJSMM301A95XQ.13.50.E06.1.454.light.4.raw
tcacgtactacacgaccggtgctcgatttagatctactgacaacacacaagggggctgtaggctcaggaggcagagctctgaatgtctcaccatggcctggatccctctcctgctccccctcctcattctctgcacagtctctgtgacctcctatgaactgacacagccatcctcagtgtcagtgtctccgggacagacggccaggatcacctgctcaggaaatattctgacaaaaaatatgctcggtggttccagcagaagccaggccaggccccagtactggtgatttataaagacattgagcggccctcagggatccctgagcgattctccggctctaattcagggaccacagtcaccttgaccatcaccggggcccagattgaggatgaggctgactattattgttactctgcggctgacaaccatctggttttcggcgggggaccaagttgaccgtcgtgggtcagcccaaggctgccccctcggtcactctcg

SEQ ID NO: 587737 - DNA, 519 bp, Homo sapiens
  misc_feature: HIJSMM301DTI5G.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaacgggaccgggtacgggaaagtaaaaacgaaaacgtagttggcgtgcaccatactgtcttc

SEQ ID NO: 587738 - DNA, 505 bp, Homo sapiens; identical to SEQ ID NO: 546412
  misc_feature: HIJSMM301A7SXI.22.21.B10.1.454.light.4.raw

SEQ ID NO: 587739 - DNA, 492 bp, Homo sapiens; identical to SEQ ID NO: 576050
  misc_feature: HIJSMM301DV5AZ.27.78.H01.1.454.light.4.raw

SEQ ID NO: 587740 - DNA, 485 bp, Homo sapiens
  misc_feature: HIJSMM301B999G.7.75.G09.1.454.light.4.raw
cgtgtctctacacgaccggtgctcgatttagtatagacatcagggggcaggagtcagacccagtcaggacacagcatggacatgagggtccccgctcagctcctggggctcctgctgctctggttccccggttcgagatgcgacatccagatgacccagtctccatcttccgtggctgcatctgtgggagacacagtcaccatcaattgtcgggcgagtcaggatgttggcgaccgcttagtctggtatcagcagaaaccaggaaaaggccctagactcctaatctatggtgcgtcccggttgcacagtggcgtcccaggaagattcagcggcggtggatctagggcagatttcactctcaccatcaatcacctgcaggctgaggattttgcaacttactactgtcagcaggctaacaggctgcccccaacctttggccaggggacacgactggagattaaacgaactgtggctgcaccatctgt

SEQ ID NO: 587741 - DNA, 497 bp, Homo sapiens; identical to SEQ ID NO: 545672
  misc_feature: HIJSMM301BX0O5.2.49.E05.1.454.light.4.raw

SEQ ID NO: 587742 - DNA, 494 bp, Homo sapiens; identical to SEQ ID NO: 534992
  misc_feature: HIJSMM301CAZHA.9.1.A01.1.454.light.4.raw

SEQ ID NO: 587743 - DNA, 509 bp, Homo sapiens; identical to SEQ ID NO: 539359
  misc_feature: HIJSMM301DMWPA.47.85.H08.1.454.light.4.raw

SEQ ID NO: 587744 - DNA, 484 bp, Homo sapiens; identical to SEQ ID NO: 537878
  misc_feature: HIJSMM301EA8J7.17.34.D01.1.454.light.4.raw

SEQ ID NO: 587745 - DNA, 504 bp, Homo sapiens
  misc_feature: HIJSMM301A9E4C.11.57.F02.1.454.light.4.raw
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaggaccaggtggaagtcagcgaactgtggctgcaccatctgtcttcatcttcccgcc

SEQ ID NO: 587746 - DNA, 489 bp, Homo sapiens; identical to SEQ ID NO: 543840
  misc_feature: HIJSMM301AWNWA.12.88.H11.1.454.light.4.raw

SEQ ID NO: 587747 - DNA, 485 bp, Homo sapiens; identical to SEQ ID NO: 539315
  misc_feature: HIJSMM301DR9NN.3.88.H11.1.454.light.4.raw

SEQ ID NO: 587748 - DNA, 506 bp, Homo sapiens
  misc_feature: HIJSMM301DSTSS.8.1.A01.1.454.light.4.raw
ctcgcgtgtccacgaccggtgctcgatttagacgtctcatcagggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgaattgccaaagaaatatgcttattggtaccagcagaagtcaggccaggcccctgtcctggtcatttatgaggacaagaaacgaccctccgggatccctgacagactctctggctccagctcagggacagtggccaccttgactatcactggggcccaggtggaggatgaaggagactactattgttactctccagagaaggatggtcatcattgggtgttcggcggagggaccaagctgaccgtcctaagtcagcccaaggctgcccctcggtcactctgttcccacctccc

SEQ ID NO: 587749 - DNA, 490 bp, Homo sapiens; identical to SEQ ID NO: 541974
  misc_feature: HIJSMM301CPDZF.22.65.F10.1.454.light.4.raw

SEQ ID NO: 587750 - DNA, 474 bp, Homo sapiens
  misc_feature: HIJSMM301A0Z34.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtaactctgttcccgccctcctcgctacgtaga

SEQ ID NO: 587751 - DNA, 501 bp, Homo sapiens
  misc_feature: HIJSMM301B881R.13.11.A11.1.454.light.4.raw
tcacgtactacacgaccggtgctcgatttagctacgactgcaggcaggggcagcaagatggtgttgcagacccaggtcttcatttctctgttgctctggatctctggtgcctacggggacatcgtgataagccagtctccagactccctggctgtgtctctgggcgagagggccaccatcaactgcaagaccagccagagtgttttatacagctccgacaataggaactacttagcttggtaccaacagaaaccaggacagcctccgaagttactcttttactgggcgtctacccgggaatccggggtccctgaccgattcagtggcagtgggtctgggacagacttcactctcaccatcagcagactggaacctgaagactttgcactttatttctgtcaccagtatggtaggtcaccgtacacttttggccaggggaccaagctggagatcaagcgaactgtggctgcaccatctgtcttcatcttcccgccatctgat

SEQ ID NO: 587752 - DNA, 489 bp, Homo sapiens
  misc_feature: HIJSMM301EKTBD.48.62.F07.1.454.light.4.raw
agtatacatacacgaccggtgctcgatttagtagtcgcataaagggaaagggggaggaactgctcagttaggacccagacggaaccatggaagccccagcgcagcttctcttcctcctgctactctggctcccagataccactggagaagtactgatgacgcagtctccagccaccctgtctgtgtctccaggggaaagagccaccctctcctgcagggccagtcagagtgttagcagcaacttagcctggtaccagcagaagcctggccaggctcccaggctcatcatctatggtgcatccaccagggccactggttgcccagcccggttcagtggtagtgggtctgggacagagttcagtctcaccatcagcagcctgcagtctgaagactttgcagtttattactgtcagcagtatgataactggcctccgttcaccttcggcggcgggaccaaggtggagatcaaacgaactgtggctgcaccat

SEQ ID NO: 587753 - DNA, 522 bp, Homo sapiens
  misc_feature: HIJSMM301AYP03.41.19.B08.1.454.light.4.raw
tctatactatcacgaccggtgctcgatttagtgagtcagtaagggggctggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggcccaaccccactgtcactctcgttcccaccctcct

SEQ ID NO: 587754 - DNA, 490 bp, Homo sapiens; identical to SEQ ID NO: 541567
  misc_feature: HIJSMM301DZYE8.22.65.F10.1.454.light.4.raw

SEQ ID NO: 587755 - DNA, 494 bp, Homo sapiens; identical to SEQ ID NO: 534992
  misc_feature: HIJSMM301A735G.9.1.A01.1.454.light.4.raw

SEQ ID NO: 587756 - DNA, 472 bp, Homo sapiens; identical to SEQ ID NO: 550621
  misc_feature: HIJSMM301AOGTN.41.8.A08.1.454.light.4.raw

SEQ ID NO: 587757 - DNA, 484 bp, Homo sapiens
  misc_feature: HIJSMM301DIMX8.47.62.F07.1.454.light.4.raw
agctcacgtacacgaccggtgctcgatttagtagtcgcataaagggaaagggggagtcagtcccaaccaggacacagcctggacatgagggtccctgctcagctcctggggctcctgctgctctggctctcaggtgccagatgtgacacccagatgacccagtctccatcctccctgtctgcatctgtaggagacagagtcaccatcacttgccaggcgagtcaggacattagcaactatttaaattggtatcagcagaaaccagggaaagcccctaagctcctgatctacgatgcatccaatttggaaacaggggtcccatcaaggttcagtggaagtggatctgggacagattttacttcaccatcagcagcctgcagcctgaagatattgcaacatattactgtcaacagtatcataatcctcccactttcggccctggaccaaagtggatatcaaacgactagtggctgcaccatctgtt

SEQ ID NO: 587758 - DNA, 521 bp, Homo sapiens; identical to SEQ ID NO: 538715
  misc_feature: HIJSMM301BMBNM.27.23.C01.1.454.light.4.raw

SEQ ID NO: 587759 - DNA, 480 bp, Homo sapiens; identical to SEQ ID NO: 557442
  misc_feature: HIJSMM301ELN4R.8.53.E09.1.454.light.4.raw

SEQ ID NO: 587760 - DNA, 498 bp, Homo sapiens
  misc_feature: HIJSMM301DQFPI.22.9.A09.1.454.light.4.raw
acatacgcgtcacgaccggtgctcgatttagcgagacgcgcagggggaggaactgctcagttaggacccagagggaaccatggaagccccagctcagcttctcttcctcctgctactctggctcccagagaccaccggagaagttgtgttgacacagtttccagccaccctgtctttgtctccaggagagcgggccaccctctcctgcagggccaatgagagtattagcgactacttagcctggtaccaacagaggcctggccaggctcccaggctcctcatgtatgatgcttccaaaagggccactggcatcccagccaggttcagtggcagtgggtctggaagagacttcactctcaccatcaacagcctagagcctgacgattctgcagtttattactgtcagcagcgtaccaagtggcctccgacttttggccagggggccaacgctggagatcagacgaactgtggctgcaccatctgtcttcatcttccccg

SEQ ID NO: 587761 - DNA, 495 bp, Homo sapiens; identical to SEQ ID NO: 535486
  misc_feature: HIJSMM301CZDBC.26.72.G06.1.454.light.4.raw

SEQ ID NO: 587762 - DNA, 464 bp, Homo sapiens
  misc_feature: HIJSMM301CBZ0E.11.73.G07.1.454.light.4.raw
cgagagataccacgaccggtgctcgatttagctctacgctcagggggcaggagtcagtcccaaccaggacacagcatggacatgagggtccctgctcagctcctggggctcctgctgctctgtctctcaggtgccagatgtgacatccagttgacccagtctccatcctccctgtctgcatctataggagacagagtcaccatcacttgccaggcgagtcaggacattaagaactatttaaattggtatcggcagcgaccagggaaagcccctgagctcctgatctacgatgcgtccaatttggaaacagaggtcccaccgaggttcagtggaagtggatctgggacagactttactctcaccatcagcagcctgcagcctgaagatattgcaacatattactgtcaacagtatgatcgtctcctcaatttcggccctgggaccagagtggacatagaaacgaa

SEQ ID NO: 587763 - DNA, 501 bp, Homo sapiens; identical to SEQ ID NO: 537545
  misc_feature: HIJSMM301EI3T9.49.69.G03.1.454.light.4.raw

SEQ ID NO: 587764 - DNA, 481 bp, Homo sapiens; identical to SEQ ID NO: 535993
  misc_feature: HIJSMM301AML0T.21.25.C03.1.454.light.4.raw

SEQ ID NO: 587765 - DNA, 485 bp, Homo sapiens; identical to SEQ ID NO: 563745
  misc_feature: HIJSMM301BKB3N.7.75.G09.1.454.light.4.raw

SEQ ID NO: 587766 - DNA, 499 bp, Homo sapiens; identical to SEQ ID NO: 575204
  misc_feature: HIJSMM301CCIHA.5.24.C02.1.454.light.4.raw

SEQ ID NO: 587767 - DNA, 507 bp, Homo sapiens
  misc_feature: HIJSMM301CZ1Z9.43.4.A04.1.454.light.4.raw
tgtgagtagtcacgaccggtgctcgatttagagtagtgatcagggtcattaatgtcagcggcacagcaaccgcgggcactttcggcggagggaccaaggtggagatcaagcgtgagtgcactttcctagtgctttttcttataaggcctgaaatttggagtctttttgtgtttgagacattacctcaggtccattccagagagttccagaggtccattccagagagttccagaggctttcaaaaaggtccgatgagtaagggatcgaaagttagtccatcttaaggagcagccaagcgctggtcagttaagagcggcgcctcatttgcaagattttctctgcgtcggccaggttagtgatcttcacgacgaaaagacatttttcttgagggaaaagtaattaagttaatgttgtggatcagcttcggccaagggacgcgactggagattaaacgaactgtggctgcaccatctgtcttcatcttccccgccatctgaactactcaca

SEQ ID NO: 587768 - DNA, 491 bp, Homo sapiens
  misc_feature: HIJSMM301D0TM3.22.65.F10.1.454.light.4.raw
acatacgcgtcacgaccggtgctcgatttagctacgctctaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacctgccgggcaagtcagagcataacgtactatttaaattggtatcagcagaaaccagggaaagcccctaagctcctgatctatgctacttccagtttgcaaagtggggtcccgtcaaggttcagtggcagtggatctgggacagatttcactctcaccatccgcggtctgcaacctgaagatttcgcaacttactactgtcaacagacttacagtgccccccgatccaccttcggccaagggacacgactggagattaaacgaactgtggctgcaccatctgtcttcatt

SEQ ID NO: 587769 - DNA, 506 bp, Homo sapiens
  misc_feature: HIJSMM301DWGOC.10.71.G05.1.454.light.4.raw
catagtagtgcacgaccggtgctcgatttagtgtcgtcgcaagagagagggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtggccactttcggtcggagggaaccaaaactaagaggtacaaacgaaactgtggctgcaccatctgtcttc

SEQ ID NO: 587770 - DNA, 500 bp, Homo sapiens
  misc_feature: HIJSMM301C9U7B.9.71.G05.1.454.light.4.raw
tgatacgtctcacgaccggtgctcgatttagtgtcgtcgcaagagagaggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgaccgtcctgagtcagcccaaggctgcccccc

SEQ ID NO: 587771 - DNA, 497 bp, Homo sapiens
  misc_feature: HIJSMM301EJ8QT.52.78.H01.1.454.light.4.raw
cgcagtacgacacgaccggtgctcgatttagtgtgagtagtttgggtttgggggctgtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctcctcagggacaacagtcacgttgatcatcagtggagtccgggcagaggacgaggctgactattactgtcaatcaacagacagtagtggtacttatgtgcagttcggcggagggaccaagctgaccgtctaggtcagcccaaggctgccccctcggt

SEQ ID NO: 587772 - DNA, 476 bp, Homo sapiens; identical to SEQ ID NO: 538611
  misc_feature: HIJSMM301A5ZW0.7.81.H04.1.454.light.4.raw

SEQ ID NO: 587773 - DNA, 487 bp, Homo sapiens
  misc_feature: HIJSMM301BFLT5.41.47.E03.1.454.light.4.raw
tctatactatcacgaccggtgctcgatttagactcgcgcacagagagaaggggtgatcaggactcctcagttcaccttctcacaatgaggctccctgctcagctcctggggctgctaatgctctgggtctctggatctagtggagagattgtgatgagtcagtctccacgctccctgtccgtcacccctggagagtcggcctccatctcctgcaagtcgagtcacaacctcctgtatagtaatggatacaattatgtggattggtacgtgcagaagccagggcagtctccacaactcctcatctatttgggttctcatcgggactccggggtccctgacaggttcactggcagtggatcaggcacagatttttaccctagaaaatcagtagagtggaggctgaggatgttggcgactattactgcctgcaagctcggcaattcccgatcaccttcggcccccgggacacgactggacattaaacgaa

SEQ ID NO: 587774 - DNA, 496 bp, Homo sapiens
  misc_feature: HIJSMM301BKQEQ.15.67.G01.1.454.light.4.raw
tctacgtagccacgaccggtgctcgatttagagtatacatattgggtttgggggcaggagtcagacccactcagtacacagcatggacatgagggtccccgctcagctcctggggctcctgctgctctggctcccaggtgccagatgtgccatccagatgacccagtctccatcctccctgtctgcatctgtaggagacagagtcaccatcacttgccgggcaagtcaggacattagaactgacttaggttggtatcagcagaaatccgggaaagcccctaagctcctgatctgtgctgcatccactttacaaagtggggtcccatcaaggttcagcggcagtggatctggcacagatttcactctcaccatcagcagcctgcagcctgaagatttcgcaacttattactgtctacaagattacaattaccctcggacgttcggtccaggggaccgaacggtggaaagtactaaacgaacctagtggctgcaccta

SEQ ID NO: 587775 - DNA, 502 bp, Homo sapiens
  misc_feature: HIJSMM301AZB1T.19.67.G01.1.454.light.4.raw
tactctcgtgcacgaccggtgctcgatttagagtatacatattgggtttggggggtagctcaggaagcagagcctggagcatctccactatggcctgggctccactacttctcaccctcctcgctcactgcacaggttcttgggccaactttatgctgactcagccccactctgtgtcggagtctccggggaagacggtaaccatcttttgcacccacaacagtggcaacattgccagcaattttgtgcagtggtaccagcagcgcccgggcagttcccccaccattgtgatctatgaggataatcaaagaccgtctggggtccctgatcggttctctggctccatcaacagctcctccaactctgcctccctcaccatctctggactgaagactgaggacgaggctgactactactgtcagtcttatgatagccgcggtcatgtggtcttcggcggagggaccaagctgaccgtcctaggtcagcccaaggctgccccctc

SEQ ID NO: 587776 - DNA, 521 bp, Homo sapiens
  misc_feature: HIJSMM301BGNCB.17.34.D01.1.454.light.4.raw
cgtagactagcacgaccggtgctcgatttagatcgtctgtgttgggtttggggtgatcaggacttctcagttcatcttctcaccatgaggctccctgctcagctcctggggctgctaatgctctggatacctggatccagtgcagatattgtgatgacccagactccactctctctgtccgtcacacctggacagccggcctccatctcctgcaagtctagtcagagcctcctgcatagtggtgaaggaaagaccttcttatattggttcctgcagaggccaggccagtctccacacctcctgatttacgaagtttccaaccgcttcgctggactgccagataggttcagtggcagcgggtcagggacagattttacactgaaaatcagccgggtggaggctgaggacgttggaattttattactgtatgacgaaggtatagagtccttcctaccgtaccggttccggaccgaacgggaaccgaagggtacggaactaccaaacgaactggtggtcgtcga

SEQ ID NO: 587777 - DNA, 491 bp, Homo sapiens; identical to SEQ ID NO: 587061
  misc_feature: HIJSMM301DIQ1G.10.77.G11.1.454.light.4.raw

SEQ ID NO: 587778 - DNA, 518 bp, Homo sapiens; identical to SEQ ID NO: 539372
  misc_feature: HIJSMM301EBWVY.7.86.H09.1.454.light.4.raw

SEQ ID NO: 587779 - DNA, 508 bp, Homo sapiens
  misc_feature: HIJSMM301BYSQ1.17.28.C06.1.454.light.4.raw
cgtagactagcacgaccggtgctcgatttagagctcacgtattgggtttggggagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtctaagtcagcccaaggctgccccctc

SEQ ID NO: 587780 - DNA, 500 bp, Homo sapiens
  misc_feature: HIJSMM301C105J.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagcggcccccgactcctcatctttaataacaatcagcggccctcaggggtccctgaccgattctctggctccaagtctggcacctcagcctcctggccatcagtgggctccagtctgaggatgaggctgattattactgtgcatcatgggctgacaccctgactggtccgggagtgttcggcggagggaccaagctgaccgtctaggtcagcccaaggcagccccctggtcact

SEQ ID NO: 587781 - DNA, 473 bp, Homo sapiens
  misc_feature: HIJSMM301EGT5K.15.81.H04.1.454.light.4.raw
tctacgtagccacgaccggtgctcgatttagtagtgtagattcgcgggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtaactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgccccctcggtcactctgttcccgccctcctcgctacgtaga

SEQ ID NO: 587782 - DNA, 495 bp, Homo sapiens
  misc_feature: HIJSMM301CHFAX.40.57.F02.1.454.light.4.raw
tctagcgactcacgaccggtgctcgatttagctcgatatagttgggtttggggctggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgtctgctcttatgcaggcagtttcgctctcgaagtgttcggcggagggaccgagctgaccgtcctacgtcagcccaa

SEQ ID NO: 587783 - DNA, 487 bp, Homo sapiens; identical to SEQ ID NO: 549460
  misc_feature: HIJSMM301BOMPY.12.31.C09.1.454.light.4.raw

SEQ ID NO: 587784 - DNA, 506 bp, Homo sapiens; identical to SEQ ID NO: 544450
  misc_feature: HIJSMM301DK407.11.75.G09.1.454.light.4.raw

SEQ ID NO: 587785 - DNA, 503 bp, Homo sapiens; identical to SEQ ID NO: 572480
  misc_feature: HIJSMM301DY433.43.57.F02.1.454.light.4.raw

SEQ ID NO: 587786 - DNA, 498 bp, Homo sapiens
  misc_feature: HIJSMM301CZDUT.48.75.G09.1.454.light.4.raw
  modified_base (477)..(477): a, c, t, g, unknown or other
agtatacatacacgaccggtgctcgatttagtatagacatcagggggatcaggacttctcagttcatcttctcaccatgaggctccctgctcagctcctggggctgctaatgctctggatccctggatccactgcgggtgttgtgttgacccaggctcccctgtctctgtccgtcacccctggacagccggccgccatgtcgtgcaattctagtcggagcctcttctatgaggacggcaggacctacttctattggtacatgcagaagccgggccggtctccacagctcctgatgtctgagatttccaggcgattccctggagtgccagagaggttcagtggcagcggagcagggacagagttcacactgaaaatcagccgggtggaggctgaggatgttggcctttattacttgcatgcaaggtatcttccttcccactacactttgtccgggaccgacggtaggagtctctaaanaaactaagtggcgtgcgacca

SEQ ID NO: 587787 - DNA, 481 bp, Homo sapiens; identical to SEQ ID NO: 535993
  misc_feature: HIJSMM301A9RAI.21.25.C03.1.454.light.4.raw

SEQ ID NO: 587788 - DNA, 504 bp, Homo sapiens; identical to SEQ ID NO: 557936
  misc_feature: HIJSMM301B7KJI.19.78.H01.1.454.light.4.raw

SEQ ID NO: 587789 - DNA, 492 bp, Homo sapiens; identical to SEQ ID NO: 544389
  misc_feature: HIJSMM301DZ6VI.22.25.C03.1.454.light.4.raw

SEQ ID NO: 587790 - DNA, 484 bp, Homo sapiens; identical to SEQ ID NO: 548960
  misc_feature: HIJSMM301AEQOH.52.53.E09.1.454.light.4.raw

SEQ ID NO: 587791 - DNA, 486 bp, Homo sapiens; identical to SEQ ID NO: 538674
  misc_feature: HIJSMM301EQC9F.47.38.D05.1.454.light.4.raw

SEQ ID NO: 587792 - DNA, 510 bp, Homo sapiens
  misc_feature: HIJSMM301EC2D2.4.71.G05.1.454.light.4.raw
agcactgtagcacgaccggtgctcgatttagtgtcgtcgcaagagagaggggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggccccaaaattggtcatctatgaagacgacaaacgaccctccgggatccctgagagattctctggctccagctcagggactatggccaccttgactatcagtggggcccaagtggaggatgaagctgactactactgttactcaatagagaacagtgataattctggtgttcggcggagggaccaaactgaccgtcctacggtcagcccaaggactgccccctccggtcactctgttccccg

SEQ ID NO: 587793 - DNA, 488 bp, Homo sapiens
  misc_feature: HIJSMM301CX3TC.4.59.F04.1.454.light.4.raw
agcactgtagcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgaggtgactcagccaccctcagtgtccgtgtccccaggacagacagccggcatcaccttctctggagataaattgggccataaatttgcttcctggtatcagcagaagccaggccagtcccctatactggtcatctatcaagataccaagcggccctcagggatccctgagcgattctctggctccaattctgggaacacagccactctgaccatcaccgggacccaggctgtagatgaggctgactattactgtcaggcgtgggacagcagcactgaggtgttcggcggagggaccaaggctgaccgtcctacgtcagcccaaggctgcccctc

SEQ ID NO: 587794 - DNA, 503 bp, Homo sapiens; identical to SEQ ID NO: 536002
  misc_feature: HIJSMM301EDOIU.51.23.C01.1.454.light.4.raw

SEQ ID NO: 587795 - DNA, 520 bp, Homo sapiens; identical to SEQ ID NO: 585123
  misc_feature: HIJSMM301EQHVG.41.19.B08.1.454.light.4.raw

SEQ ID NO: 587796 - DNA, 504 bp, Homo sapiens; identical to SEQ ID NO: 535561
  misc_feature: HIJSMM301C55ZV.4.57.F02.1.454.light.4.raw

SEQ ID NO: 587797 - DNA, 482 bp, Homo sapiens; identical to SEQ ID NO: 550464
  misc_feature: HIJSMM301BIPEU.13.50.E06.1.454.light.4.raw

SEQ ID NO: 587798 - DNA, 494 bp, Homo sapiens
  misc_feature: HIJSMM301EDO64.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaaacttcctacacttttggccagggaccaagctggagatcaaacgaactgtggctgca

SEQ ID NO: 587799 - DNA, 507 bp, Homo sapiens
  misc_feature: HIJSMM301EB1XY.4.6.A06.1.454.light.4.raw
agcactgtagcacgaccggtgctcgatttagatctactgacagggggcttcagctgtgggtagagaagacaggactcaggacaatctccagcatggccagcttccctctcctcctcaccctcctcactcactgtgcagggtcctgggcccagtctgtcctgactcaggcaccctcagcgtctggggcccccgggcagagggtcatcctctcttgttctggaggcagctccaacatcggaggacatcctgtgagctggtaccaacacctcccaggaacggcccccaaactcctcatctatacagattctaagaggcccgcaggggtcccagatcgattctctggctccaggtctggcacctcagcctccctgtccatcagtggactccggtctgaggatgaggctgactactattgttcaggatgggattacagcctacatgctcggctgttcggcggagggaaccaaactgaccgtcttaggtcacgcccaaggcctcgtccccccg

SEQ ID NO: 587800 - DNA, 501 bp, Homo sapiens; identical to SEQ ID NO: 542364
  misc_feature: HIJSMM301DGQNV.7.71.G05.1.454.light.4.raw

SEQ ID NO: 587801 - DNA, 511 bp, Homo sapiens
  misc_feature: HIJSMM301DFSDF.15.59.F04.1.454.light.4.raw
tctacgtagccacgaccggtgctcgatttagtacacacacttagggattgggggaaaaggccctgaggaaaacaaaccccagctgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactaccccagctggtaccaacagaccccaggccagcctccacgcacgctcatctatagcacaaacactcgctcttctggggtccctgatcgcttctctggctccatccttggaaacaagctgccctcaccatcacgggggcccaggcagatgatgaatctgtttattattgtgtcctatatatgggtgctggcatttcggtcttcggcggagggaccaagctgaccgtccta

SEQ ID NO: 587802 - DNA, 496 bp, Homo sapiens; identical to SEQ ID NO: 537925
  misc_feature: HIJSMM301C5K37.22.14.B03.1.454.light.4.raw

SEQ ID NO: 587803 - DNA, 485 bp, Homo sapiens; identical to SEQ ID NO: 538194
  misc_feature: HIJSMM301AY9XL.47.62.F07.1.454.light.4.raw

SEQ ID NO: 587804 - DNA, 499 bp, Homo sapiens
  misc_feature: HIJSMM301BJ9DB.53.10.A10.1.454.light.4.raw
cgcgtatacacacgaccggtgctcgatttagcgtcgatctcagggggggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgaccatcagcgggacccagactatggatgaggctgactattactgtcaggcatgggacagcgaaattgcggtgttcggcggggggaccaaactgaccgtcctaggtcagcccaaggctgccccctcggtcactctgttcccgccct

SEQ ID NO: 587805 - DNA, 472 bp, Homo sapiens; identical to SEQ ID NO: 535992
  misc_feature: HIJSMM301E0RCL.11.76.G10.1.454.light.4.raw

SEQ ID NO: 587806 - DNA, 502 bp, Homo sapiens
  misc_feature: HIJSMM301EB7PD.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcacggctgaagatgtggcagtttattactgtcaacagttttctcgggcgtcgcaaggaccaacggtggaagtcaaacgaactagtggctgcaccatctgtcttctatcttccccg

SEQ ID NO: 587807 - DNA, 503 bp, Homo sapiens; identical to SEQ ID NO: 540136
  misc_feature: HIJSMM301EBQM4.19.10.A10.1.454.light.4.raw

SEQ ID NO: 587808 - DNA, 485 bp, Homo sapiens; identical to SEQ ID NO: 535363
  misc_feature: HIJSMM301DAGSE.17.26.C04.1.454.light.4.raw

SEQ ID NO: 587809 - DNA, 508 bp, Homo sapiens
  misc_feature: HIJSMM301E0UF3.10.55.E11.1.454.light.4.raw
catagtagtgcacgaccggtgctcgatttagcactcgcacgttgggtttgggggagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggcaaaaacctggccaggctccccgactcctcttctttggtggagcctacagggccactggcaccccagacaggatcagtggcagcgggtctgggacagacttcattctcaccatcaacagactgcagcctgaagatattgcagtttactactgtcagcagtatgttacgtccccgtggacgttcggccaagggaccaaggtggcaatcaaccgaactagtggctgcaccatctgtcttcatcttcccgccat

SEQ ID NO: 587810 - DNA, 506 bp, Homo sapiens
  misc_feature: HIJSMM301EHHYW.21.87.H10.1.454.light.4.raw
tcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagttcgattctctgcatccaagtctggcaacacggcctttctgacaatctctcaactccaggctgaagacgagctatttattactgctcctcatacgcaggtggcacatttttcttggtttttggtggcgggacccagatgactgtcctcagtcagcccaaggctgccccctggt

SEQ ID NO: 587811 - DNA, 510 bp, Homo sapiens
  misc_feature: HIJSMM301BBS0S.11.1.A01.1.454.light.4.raw
cgagagataccacgaccggtgctcgatttagacgtctcatcaggggaggggcagttggtagatgcccctctgggagagatccccaggggtgacagccatggaccctggaagggcctgggctagggacagggaccagagccagtccagggagaggacagagccaatggactggggtgtactgtaacagccctgttggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcgggacccagaccctggagcctcagttggaagcagccgatccagcctgcggagcctgtgggcaggtcagcccaaggccaacccactgtcactctcg

SEQ ID NO: 587812 - DNA, 507 bp, Homo sapiens
  misc_feature: HIJSMM301AITIK.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctcgcccccg

SEQ ID NO: 587813 - DNA, 507 bp, Homo sapiens
  misc_feature: HIJSMM301C4JZI.4.57.F02.1.454.light.4.raw
agcactgtagcacgaccggtgctcgatttagctcgatatagttgggtttgggggcctaaggaagcagcactggtggtgcctcagccatggcctggaccgttctcctcctcggcctcctctctcactgcacaggctctgtgacctcatatgtgctgactcagccaccctcagtgtcagtggccccagggcagacggccagggataacctgtgtgggaaccagcatcggaggtaaagtgtacattggtacaggcagaagccaggccaggcccctgtggtggtcgtccgttatgatagcgaccggccctcagggatccctgagcgattctctggctccaactctgggaacacggccaccctgaccatcagcagggtcgaagccggggatgaggccgactattactgtcaggtgtgggatagtagtggtgatcatccatacgtcttcggaactgggaccaaggtctccgtcctacgtcagcccaaggccaacccactgtcactctgttccg

SEQ ID NO: 587814 - DNA, 480 bp, Homo sapiens
  misc_feature: HIJSMM301ELMCL.49.12.B01.1.454.light.4.raw
agtcgagagacacgaccggtgctcgatttagtagtgtagattccgcgggggcaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctacactcactttcgcggaggaccacggtggagatcaaacgaactgtggctgcacc

SEQ ID NO: 587815 - DNA, 521 bp, Homo sapiens; identical to SEQ ID NO: 548887
  misc_feature: HIJSMM301AUD57.5.27.C05.1.454.light.4.raw

SEQ ID NO: 587816 - DNA, 495 bp, Homo sapiens; identical to SEQ ID NO: 569769
  misc_feature: HIJSMM301AII0M.9.1.A01.1.454.light.4.raw

SEQ ID NO: 587817 - DNA, 518 bp, Homo sapiens; identical to SEQ ID NO: 580721
  misc_feature: HIJSMM301CFAY5.43.59.F04.1.454.light.4.raw

SEQ ID NO: 587818 - DNA, 486 bp, Homo sapiens; identical to SEQ ID NO: 535917
  misc_feature: HIJSMM301BGMRL.3.10.A10.1.454.light.4.raw

SEQ ID NO: 587819 - DNA, 482 bp, Homo sapiens
  misc_feature: HIJSMM301A9SMA.49.37.D04.1.454.light.4.raw
agtcgagagacacgaccggtgctcgatttagtagcatactgttgggtttgggggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacattcgcaactatttaaattggtatcagcagaaaccagggaaagcccctaaactcttgatctacgatgtctccaatttggaaacaggggtcccatcaaggttcagtggaagtggatctgggacagattttactttcaccatcagcagcctgcagcctgaagatattgcaacatattactgtcaacagtatgataatctcccactcactttcggcggagggaccaaggtggagatcaaacgaactgtggctgcacc

SEQ ID NO: 587820 - DNA, 501 bp, Homo sapiens
  misc_feature: HIJSMM301DKKIT.40.31.C09.1.454.light.4.raw
tctagcgactcacgaccggtgctcgatttagacgtctcatcaaggaaggaagggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 587821 - DNA, 486 bp, Homo sapiens; identical to SEQ ID NO: 565571
  misc_feature: HIJSMM301CU1A5.5.6.A06.1.454.light.4.raw

SEQ ID NO: 587822 - DNA, 517 bp, Homo sapiens; identical to SEQ ID NO: 552807
  misc_feature: HIJSMM301DP9TI.10.26.C04.1.454.light.4.raw

SEQ ID NO: 587823 - DNA, 512 bp, Homo sapiens; identical to SEQ ID NO: 541468
  misc_feature: HIJSMM301A7GGV.5.58.F03.1.454.light.4.raw

SEQ ID NO: 587824 - DNA, 491 bp, Homo sapiens
  misc_feature: HIJSMM301D7932.16.53.E09.1.454.light.4.raw
tgtactactccacgaccggtgctcgatttagagagagtgtgttgggtttgggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggatacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggggtttattactgcatgcaagctctacaaactccttactactttggccaggggaccaagctggagatcaaacgaactgt

SEQ ID NO: 587825 - DNA, 497 bp, Homo sapiens
  misc_feature: HIJSMM301DFCJJ.12.67.G01.1.454.light.4.raw
atacgacgtacacgaccggtgctcgatttagagtatacatattgggttgggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcagagcccccaaactcatgatttttgatgtcactaatcggccctcaggggtttctgatcgcttctctggctccaagtctgactacacggcctccctgaccatctctgggctccaggctgaggacgaggctgattattattgcagctcatatacaagcagcagcaccctctttgtcttcggaagtgggaccaaggtcaccgtctacgtcagcccaaggccaaccca

SEQ ID NO: 587826 - DNA, 470 bp, Homo sapiens
  misc_feature: HIJSMM301E0MNM.51.37.D04.1.454.light.4.raw
cgatcgtatacacgaccggtgctcgatttagtagcatactgttgggtttggggagtcccaaccaggacacagcatggacatgagggtccctgctcagctcctggggctcctgctgctctggctctcaggtgccagatgtgtcatccagatgacccagtctccatcctccctgtctgcatctataggagacagaatcaccatcacttgccgggcgagtcgagacattagcatgtatctgaattggtatcagcaaaaaccagggacagcccctaaactcctgatcctcgatgcatccactttggaaacaggggtcccatcaaggttcagtggaagtggctctgggacagattttactttcaccatcagcaggctgcagcctgaagacattgcaacatattactgtcaacagtatgatagtctcccgctcactttcggcgggggaccgaaggtggagatcaagcgaactgtgg

SEQ ID NO: 587827 - DNA, 502 bp, Homo sapiens
  misc_feature: HIJSMM301CXPEA.43.34.D01.1.454.light.4.raw
tgtgagtagtcacgaccggtgctcgatttagatcgtctgtgttggggtttgggggggtcgacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtctaggtcagcccaaggccaacccctac

SEQ ID NO: 587828 - DNA, 495 bp, Homo sapiens
  misc_feature: HIJSMM301BG9DG.18.59.F04.1.454.light.4.raw
tacgagtatgcacgaccggtgctcgatttagtacacacacttagggattgggggctggggtctcaggaggcagcgctctcgggacgtctccaccatggcctgggctctggctattcctcaccctcctcactcagggcacagggtcctgggcccagtctgccctgactcagcctgcctccgtgtctgggtctcctggacagtcgatcaccatctcctgcactggaaccagcagtgacgttggtgttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcaccagcactctctatgtcttcggaactgggaccaaggtcaccgtctaggtcagcccagg

SEQ ID NO: 587829 - DNA, 507 bp, Homo sapiens; identical to SEQ ID NO: 564208
  misc_feature: HIJSMM301A8IXL.5.24.C02.1.454.light.4.raw

SEQ ID NO: 587830 - DNA, 478 bp, Homo sapiens; identical to SEQ ID NO: 541928
  misc_feature: HIJSMM301EJ7T2.7.76.G10.1.454.light.4.raw

SEQ ID NO: 587831 - DNA, 513 bp, Homo sapiens; identical to SEQ ID NO: 562804
  misc_feature: HIJSMM301CBE80.10.80.H03.1.454.light.4.raw

SEQ ID NO: 587832 - DNA, 361 bp, Homo sapiens; identical to SEQ ID NO: 540413
  misc_feature: HIJSMM301EEF5R.3.57.F02.1.454.light.4.raw

SEQ ID NO: 587833 - DNA, 512 bp, Homo sapiens
  misc_feature: HIJSMM301D4T26.7.39.D06.1.454.light.4.raw
cgtgtctctacacgaccggtgctcgatttagtgacatctcgcagttctttgggggtgggctcaggaggcagagctctgggaatctcaccatggcctggacccctctcctgctccccctcctcactttctgcacagtctctgaggcctcctatgaactgacacagccaccctcggtgtcagtgtccccaggacaaacggccaggatcacctgctctggaaatccatcgccaataagatctgttcattggtaccaccagaggtccggccaggcccctgtgcttgtcgtctatgcggacacaaagcgcccctccgggatccctgagagattctctggctccagctcagggacagtggccaccttgactatcagcggggcccaggtggacgatgaaggtgactacttctgtttctcaatagacgccagcggtgaccatagggtgttcggcggagggaccagggtgaccgtcctaggtcagcccaaggctgccccctggtcactctgttcccaccct

SEQ ID NO: 587834 - DNA, 498 bp, Homo sapiens
  misc_feature: HIJSMM301AM6QT.48.67.G01.1.454.light.4.raw
agtatacatacacgaccggtgctcgatttagagtatacatattgggtttggggactgctcagttaggacccagagggaaccatggaagccccagcccagcttctcttcctcctgctactctggctcccagcagccaccggagaaattgtgctgacacagtctccagccaccctgtccttgtctccagggcaaagagcctccctctcctgcagggccagtcagcatgttagcacctacttagcctggtaccaacaaaagcctggccaggctcccagactcctcatctatgatgcgtctaccagggccactggcgtcccggccaggttcagtgccagtgggtctgggacagacttcactctcaccatcagcagcctagagcccgaagattttgcggtttattactgtcagcagcgtgccaactggcctctcacgttcggcggagggaccaaggtggacatcaaacgaactgtggctgcaccatctgtcttcatcttcccg

SEQ ID NO: 587835 - DNA, 507 bp, Homo sapiens
  misc_feature: HIJSMM301A69O4.12.53.E09.1.454.light.4.raw
  modified_base (488)..(488): a, c, t, g, unknown or other
atacgacgtacacgaccggtgctcgatttagagagagtgtgttgggtttgggggctttgcctgggctctgctgctcctcactctcctcactcaggacacagggtcctgggcccagtctgccctgactcagcctgcctccgtgtctgggtctcctggacagtcgatcaccatctcctgcactgggaccagcagtgatgttgggacttataaccttgtctcctggtaccaacaacacccaggcaaagcccccaaactcatgatttatgagggcactaagcggcctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtcagccaacggctcgccccctcggtcactctcttacccnccctccttctacgtcgtat

SEQ ID NO: 587836 - DNA, 517 bp, Homo sapiens
  misc_feature: HIJSMM301EQTJ7.14.70.G04.1.454.light.4.raw
  modified_base (507)..(507): a, c, t, g, unknown or other
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaacccacngtcactctcg

SEQ ID NO: 587837 - DNA, 488 bp, Homo sapiens
  misc_feature: HIJSMM301CYAZP.15.49.E05.1.454.light.4.raw
tctacgtagccacgaccggtgctcgatttagagcgactagcaacacacaaagggggaggaactgctcagttaggacccagacggaaccatggaagccccagcgcagcttctcttcctcctgctactctggctcccagataccactggagaaatagtaatgacgcagtctccagccaccctgtctgtgtctccaggggaaagagccaccctctcctgcagggccagtcagagtattgacagcaagttagcctggtaccagcagaaacctggccagactcccagactcgtcatctttgctacatctgccagggccactggcatcccagccacgttcagtggcagtgggtctgggacagagttcattctcaccatcagcagcctgcagtctgaagattttgcagtttattactgtcagcagtataatgactggcctccgacgttcggccaagggaccaaggtggaatcaaacgaactagtggctgcaccat

SEQ ID NO: 587838 - DNA, 494 bp, Homo sapiens; identical to SEQ ID NO: 535478
  misc_feature: HIJSMM301A29AF.10.79.H02.1.454.light.4.raw

SEQ ID NO: 587839 - DNA, 489 bp, Homo sapiens
  misc_feature: HIJSMM301AZ4MR.43.36.D03.1.454.light.4.raw
tgtgagtagtcacgaccggtgctcgatttagctgcgtcacgatctctcttgggggagctacaacaggcaggcaggggcagcaagatggtgttgcagacccaggtcttcatttctctgttgctctggatctctggtgccttcggggacatcgtgatgacccagtctccaggttccctggctgtctctctgggcgagagggccacgctcaagtgcacctccagcgagagtgtgttgtactccccccacccatcagcacgccttagcctggtaccagcacaagtcagggcagcctcctaagttgctcttttactggacttcgatccgcgcatctggggtccctgaccgattcatgggcagcggctctgggacagacttcgctctcaccatcaacagcctccaggctgaggatgcggcggtttattattgtcaacaattattttagtgctccgtacacttttggccaggggaccaagttggagatcaaacgaa

SEQ ID NO: 587840 - DNA, 494 bp, Homo sapiens; identical to SEQ ID NO: 534992
  misc_feature: HIJSMM301B217S.9.1.A01.1.454.light.4.raw

SEQ ID NO: 587841 - DNA, 516 bp, Homo sapiens
  misc_feature: HIJSMM301C5GFF.15.86.H09.1.454.light.4.raw
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccacacaattgatggccaaagacggttgggtgttcggcggagggaccaaggctgaccgtcctaggtcagcccaaggctgccccctcggtcactctgttcccgccctcctcgctacgtaga

SEQ ID NO: 587842 - DNA, 504 bp, Homo sapiens; identical to SEQ ID NO: 551974
  misc_feature: HIJSMM301A8Z83.19.78.H01.1.454.light.4.raw

SEQ ID NO: 587843 - DNA, 522 bp, Homo sapiens; identical to SEQ ID NO: 540226
  misc_feature: HIJSMM301DO92Y.27.23.C01.1.454.light.4.raw

SEQ ID NO: 587844 - DNA, 510 bp, Homo sapiens
  misc_feature: HIJSMM301DZB86.17.33.C11.1.454.light.4.raw
cgtagactagcacgaccggtgctcgatttagagtgagctcgttgggtttggggtctggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccgt

SEQ ID NO: 587845 - DNA, 488 bp, Homo sapiens; identical to SEQ ID NO: 555249
  misc_feature: HIJSMM301EXNIJ.17.34.D01.1.454.light.4.raw

SEQ ID NO: 587846 - DNA, 483 bp, Homo sapiens
  misc_feature: HIJSMM301C5MK9.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagatttgcagtctattactgtcagcagtatggtcacgtccaagaacttttggccagggaccaagctggagatcaaacgaactgtggctgcaccat

SEQ ID NO: 587847 - DNA, 498 bp, Homo sapiens; identical to SEQ ID NO: 574535
  misc_feature: HIJSMM301BKGZL.48.82.H05.1.454.light.4.raw

SEQ ID NO: 587848 - DNA, 495 bp, Homo sapiens
  misc_feature: HIJSMM301DS02C.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgctaacttactactgtcaacagagttacacgtacccccctcacctttcggcggacgggaccgaaggcggagatcagacgaactgtggctgcaccatctgtcttcta

SEQ ID NO: 587849 - DNA, 487 bp, Homo sapiens
  misc_feature: HIJSMM301ENUQD.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctcctgaccattactggactccagcctgaggacgaggctgactattactgctcagcatgggacaggcggcctcaggacttatgtcttcggaactgggacccacgttaccgtcctaggtcagacccg

SEQ ID NO: 587850 - DNA, 495 bp, Homo sapiens
  misc_feature: HIJSMM301A9MIM.3.31.C09.1.454.light.4.raw
  modified_base (477)..(477): a, c, t, g, unknown or other
agacgcactccacgaccggtgctcgatttagacgtctcatcaaggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgnggctgcaccatctgtctt

SEQ ID NO: 587851 - DNA, 497 bp, Homo sapiens
  misc_feature: HIJSMM301EJOVK.3.35.D02.1.454.light.4.raw
agacgcactccacgaccggtgctcgatttagcacacgatagttgggtttggggtgatcaggactcctcagttcaccttctcacaatgaggctccctgctcagctcctggggctgctaatgctctgggtcccaggatccagtggggatgttgtggtgactcagtctccactctccctgcccgtcacccttggacagccggcctccatctcctgcaggtctggtcaaagcctcgtgtacggtgatggaaacacctacttgaattggtatcagcagaggccaggccaatctccaaggcgcctaatctataaggtttctaaccgggacgctggggtcccagacagattcagcggcactgggtcaggcactgatttcacactgagaattagcagggtggaggctgaggatgttgggattatttctgcatgcaagctacacactggccgtacacttttggccaggggaccaagctggagatcaaacgaactgtggctgcacca

SEQ ID NO: 587852 - DNA, 490 bp, Homo sapiens
  misc_feature: HIJSMM301BS1KW.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccaagggaccaaagtggacatcaagcgaactgtggctgcaccatctgt

SEQ ID NO: 587853 - DNA, 502 bp, Homo sapiens; identical to SEQ ID NO: 536253
  misc_feature: HIJSMM301AKQWE.21.22.B11.1.454.light.4.raw

SEQ ID NO: 587854 - DNA, 531 bp, Homo sapiens
  misc_feature: HIJSMM301BZOGA.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagatttgcagtatattactgtcagcaatatggtactccaccccggacgttcggtccgaacgggaccgaacggtaggaaggtacgaaacgaaaccgtagtaggcgtgcaccgactctcgtcttctactcttccgtccctactctcgt

SEQ ID NO: 587855 - DNA, 494 bp, Homo sapiens; identical to SEQ ID NO: 536221
  misc_feature: HIJSMM301ESAU8.15.59.F04.1.454.light.4.raw

SEQ ID NO: 587856 - DNA, 480 bp, Homo sapiens
  misc_feature: HIJSMM301AIVCU.11.11.A11.1.454.light.4.raw
cgagagataccacgaccggtgctcgatttagctacgactgcaggggcagcaagatggtgttgcagacccaggtcttcatttctctgttgctctggatctctggtgcctgtggggacatcctgatgacccagtccccagatatcctgcctgtgtctctgggcgagagggccaccatcgagtgcaagtccagcgagactcttttatatagtgtcaacgataaggactatttagcttggtatcagcaaaaaccaggacagcctcctaaactgctcatctcctgggcatctacccgggcacccggagtccctgaccgattcagtggcagcgggtctgggacagacttcactctcaccatcagcaacctgcaggctgaagatgtggctagtttattactgtcagcagtattgtgaagctccgctcactttcggcggagggaccggcggtggagatcagacgaactgtggctgcaccatctgtctt

SEQ ID NO: 587857 - DNA, 474 bp, Homo sapiens
  misc_feature: HIJSMM301DT3IA.52.59.F04.1.454.light.4.raw
cgcagtacgacacgaccggtgctcgatttagtacacacacttagggattgggggcagaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcaggggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaaacgaa

SEQ ID NO: 587858 - DNA, 493 bp, Homo sapiens; identical to SEQ ID NO: 536246
  misc_feature: HIJSMM301BMLJJ.49.66.F11.1.454.light.4.raw

SEQ ID NO: 587859 - DNA, 510 bp, Homo sapiens
  misc_feature: HIJSMM301ARE9W.8.42.D09.1.454.light.4.raw
ctcgcgtgtccacgaccggtgctcgatttagacacatacgcagggaaagggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggagccagcagtgattacaactatatctcctggtaccaacaacacccaggcaaagcccccaaactcatgatttttgaggtcaataagcggccctcaggggtccctgatcgcttctcaggctccaagtctggcaacacggcctccctgaccgtctctgggctccagactgaggatgaggctgattattactgcagctcatattcaggcagcaacagggtattcggcggagggaccaagttgaccgtcctaggtcagcccaaggctcgccccctcggtcactctcgttcccaccct

SEQ ID NO: 587860 - DNA, 499 bp, Homo sapiens
  misc_feature: HIJSMM301BKDOH.48.38.D05.1.454.light.4.raw
agtatacatacacgaccggtgctcgatttagtatctgatagttgggtttgggggctggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtggttataactatgtctcctggtaccaacagcacccaggcaaagcccccaaagtcatgatttatgaggtcagtaagcggccctcaggggtccctgatcgcttctctggctccaagtctggcaacacggcctccctgaccgtctctgggcctccaggctgaggatgaggctgattattactgcagctcatatgcaggcagcaacaatgtgtattcggcggaggaccaagctgaccgtcctaggtcagcccaaggctcccg

SEQ ID NO: 587861 - DNA, 486 bp, Homo sapiens; identical to SEQ ID NO: 535290
  misc_feature: HIJSMM301DKQU8.3.12.B01.1.454.light.4.raw

SEQ ID NO: 587862 - DNA, 481 bp, Homo sapiens
  misc_feature: HIJSMM301BACJQ.12.11.A11.1.454.light.4.raw
atacgacgtacacgaccggtgctcgatttagctacgactgcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgctgggagtgataagtttgtctcctggtaccaacatcacccaggcaaagcccccagactcatgatttatgagggcactaagcggccctcaggggtttcttatcgcttctctggctccgagtctggcaacacggcctccctgacaatctctgggctccaggctgaggacgaggcggattattactgttgctcatatgcgggtagtagcactttcgatgtcctattcggcggagggaccaagctgaccgtcctgggtc

SEQ ID NO: 587863 - DNA, 447 bp, Homo sapiens; identical to SEQ ID NO: 535020
  misc_feature: HIJSMM301BH8BN.18.9.A09.1.454.light.4.raw

SEQ ID NO: 587864 - DNA, 478 bp, Homo sapiens; identical to SEQ ID NO: 563839
  misc_feature: HIJSMM301BEQHF.13.11.A11.1.454.light.4.raw

SEQ ID NO: 587865 - DNA, 485 bp, Homo sapiens; identical to SEQ ID NO: 556307
  misc_feature: HIJSMM301AJFXX.49.64.F09.1.454.light.4.raw

SEQ ID NO: 587866 - DNA, 488 bp, Homo sapiens
  misc_feature: HIJSMM301BBEWL.15.28.C06.1.454.light.4.raw
tctacgtagccacgaccggtgctcgatttagagctcacgtattgggtttggggagtcagactcagtcaggacacagcatggacatgagggtccccgctcagctcctggggctcctgctgctctggctcccaggtgccaaatgtgacatccagatgacccagtctccgtccaccctgtctgcatctgtcggagacagagtcaccatcacttgccgggccagtcagagtattactaaatggttggcctggtttcagcagaaaccagggaaagccccaaaagtcctgatctctgccgcctctactttgcaaagtggggtcccatcaaggttcagcggcagtggatctgggacagaattcagtctcaccatcagcagcctgcagcctgacgattttgcaacttactactgccaagtgcataataatcatttcggcggagggaccaaggtggagatcaaacgaactgtggctgcaccatctgtcttcattccc

SEQ ID NO: 587867 - DNA, 497 bp, Homo sapiens; identical to SEQ ID NO: 536376
  misc_feature: HIJSMM301CWQ5K.22.9.A09.1.454.light.4.raw

SEQ ID NO: 587868 - DNA, 499 bp, Homo sapiens
  misc_feature: HIJSMM301CP3L0.18.11.A11.1.454.light.4.raw
tacgagtatgcacgaccggtgctcgatttagctacgactgcaggggcagcaagatggtgttgcagacccaggtcttcatttctctgttgctctggatctctggtgccgacggggacatcgtgatgacccagtctccagactccctggttgtgtctctgggcgagagggccaccatcaactgcaagtccagccagagtgttttatacagctccaacaataacaactacttagcttggtaccagcagaaaccaggacagccccctaaggtcctcatttactgggcatctacccgggagtccggggtccctgaccgattcagaggcagcgggtctgggacagatttcactctcaccatcaccaacctgcaggctgaagatgtggcagtttattactgtcagcaatactatagtcctcctctcacgttcggcggagggaccaagggtgagatcaaacgaactgtggctgcaccatctgtccttcatcttccccgcatctgacc

SEQ ID NO: 587869 - DNA, 521 bp, Homo sapiens; identical to SEQ ID NO: 538715
  misc_feature: HIJSMM301DD761.27.23.C01.1.454.light.4.raw

SEQ ID NO: 587870 - DNA, 486 bp, Homo sapiens; identical to SEQ ID NO: 535385
  misc_feature: HIJSMM301B88S4.19.71.G05.1.454.light.4.raw

SEQ ID NO: 587871 - DNA, 513 bp, Homo sapiens
  misc_feature: HIJSMM301B06P4.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcacacttttatgttcgggactgggaccaaggtcaccgtcctaggtcagcccaaggccaaccccactcgtcactctcg

SEQ ID NO: 587872 - DNA, 488 bp, Homo sapiens; identical to SEQ ID NO: 540342
  misc_feature: HIJSMM301ET69L.43.33.C11.1.454.light.4.raw

SEQ ID NO: 587873 - DNA, 498 bp, Homo sapiens
  misc_feature: HIJSMM301DRH2P.47.66.F11.1.454.light.4.raw
agctcacgtacacgaccggtgctcgatttagtcacgcgagaagggggaggaactgctcagttaggacccagagggaaccatggaagccccagctcagcttctcttcctcctgctactctggctcccagaaatcgccggagacattctattgacacaggctccagtcaccctgtctttgtctccaggggaaagagccaccctctcctgcagggccagtcaaagcatcggcaacaatttggcctggtatcaacagaaacctggccaggctcccaggctcctcatctacgatgcatccaacagggccactggcgtcccaggcaggttcagaggcggtgggtctgggacagacttcactctcaccattgacggcctagagcctgaagattttgcagtttattactgtcagcagcgtaacaattgccgatcaccttcggccaagggacagactggagattaaacgaactgtggctgcaccatctgtcttcatcttcccgccat

SEQ ID NO: 587874 - DNA, 486 bp, Homo sapiens; identical to SEQ ID NO: 535043
  misc_feature: HIJSMM301EGEE0.46.35.D02.1.454.light.4.raw

SEQ ID NO: 587875 - DNA, 503 bp, Homo sapiens; identical to SEQ ID NO: 547049
  misc_feature: HIJSMM301DB3PI.18.59.F04.1.454.light.4.raw

SEQ ID NO: 587876 - DNA, 486 bp, Homo sapiens; identical to SEQ ID NO: 535043
  misc_feature: HIJSMM301CDFYS.46.35.D02.1.454.light.4.raw

SEQ ID NO: 587877 - DNA, 521 bp, Homo sapiens; identical to SEQ ID NO: 539470
  misc_feature: HIJSMM301BGRZJ.27.23.C01.1.454.light.4.raw

SEQ ID NO: 587878 - DNA, 505 bp, Homo sapiens; identical to SEQ ID NO: 535987
  misc_feature: HIJSMM301ARAQS.18.37.D04.1.454.light.4.raw

SEQ ID NO: 587879 - DNA, 493 bp, Homo sapiens
  misc_feature: HIJSMM301ASZ67.51.61.F06.1.454.light.4.raw
cgatcgtatacacgaccggtgctcgatttagctacgctctaagggaaaggggagtcccagtcaggacacagcatggacatgagggtccccgctcagctcctggggctcctgctgctctggctcccaggtgccagatgtgacatccagttgacccagtctccatccttcctgtctgcatctgtaggagacagagtcaccatcacttgccgggccagtcagggcattagcatttctttagcctggtatcagcaaaaaccagggaaagcccctaagctcctgatctatgctgcatccactttgcaaactggagtcccatcaaggttcagcggcagtggatctgggacagaattcactctcacaatcagcagcctgcagcctgaagattttgcaacttattactgtcaacagcttaatacttatcctcggacgttcggtccaacgggaccgaacggtaggaaagtacaaacgaactagtggcgtgcaccactctgtt

SEQ ID NO: 587880 - DNA, 448 bp, Homo sapiens; identical to SEQ ID NO: 540364
  misc_feature: HIJSMM301C8QDC.18.9.A09.1.454.light.4.raw

SEQ ID NO: 587881 - DNA, 493 bp, Homo sapiens
  misc_feature: HIJSMM301BA1UU.4.20.B09.1.454.light.4.raw
agcactgtagcacgaccggtgctcgatttagtgtagtgtgaagggggagctacaacaggcaggcaggggcagcaagatggtgttgcagacccaggtcttcatttctctgttgctctggatctctggtgcctacggggacatcgtgatgacccagtctccggactccctggctgtgtctctgggcgagagggccaccatcaactgcaagtccagccagagtgttttatacaactccaacaataagaactacttagcttggtaccagcagagaccaggacagcctcctaagctgctcatttactgggcatctacccgggaatccggggtccctgaccgattcagtggcagcgggtctgggacagatttcactctcgccatcagcagcctgcagcctgacgatgtggcagtttattactgccagcaatattatactgacccgtggacgttcggccaagggaccaaggtggaaatacaaacgaactgtggctgcacc

SEQ ID NO: 587882 - DNA, 505 bp, Homo sapiens
  misc_feature: HIJSMM301EV68D.16.46.E02.1.454.light.4.raw
tgtactactccacgaccggtgctcgatttagactcatctacagggaaagggggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactggaccaaggtcaccgtcctaggtcagcccaaggccaacccactgtcact

SEQ ID NO: 587883 - DNA, 498 bp, Homo sapiens
  misc_feature: HIJSMM301CVRQZ.48.42.D09.1.454.light.4.raw
agtatacatacacgaccggtgctcgatttagacacatacgcagggattgggggaagagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcta

SEQ ID NO: 587884 - DNA, 504 bp, Homo sapiens; identical to SEQ ID NO: 576923
  misc_feature: HIJSMM301D2R17.8.19.B08.1.454.light.4.raw

SEQ ID NO: 587885 - DNA, 487 bp, Homo sapiens
  misc_feature: HIJSMM301AGJ8U.14.68.G02.1.454.light.4.raw
  modified_base (433)..(433): a, c, t, g, unknown or other
cgtctagtaccacgaccggtgctcgatttagtcgatagtgaagggaaagggggcaggagtcagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccatcacttgccaggcgagtcaggacatcaggaaatatttaaattggtatcagcagaaaccagggaaagcccctaaactcctgatcttcgatgcatccaatttggaaacaggggtcccatcaaggttcaggggaagtggatctgggacagattttagtttcaccatcagcagcctgcagcctgaagatattggaacatattactgtcaacagtatgataatttaccgntcactttcggcggagggaccaaggtggacatcaaacgaactgtggctgcaccat

SEQ ID NO: 587886 - DNA, 508 bp, Homo sapiens; identical to SEQ ID NO: 540739
  misc_feature: HIJSMM301BUIMD.14.7.A07.1.454.light.4.raw

SEQ ID NO: 587887 - DNA, 487 bp, Homo sapiens
  misc_feature: HIJSMM301DN58Z.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccacgatacgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattatatacttcgtggacgttcggccaagggaccaaggtggatatcagacgaa

SEQ ID NO: 587888 - DNA, 489 bp, Homo sapiens; identical to SEQ ID NO: 535139
  misc_feature: HIJSMM301CHJI1.14.55.E11.1.454.light.4.raw

SEQ ID NO: 587889 - DNA, 502 bp, Homo sapiens
  misc_feature: HIJSMM301AJZS9.13.55.E11.1.454.light.4.raw
tcacgtactacacgaccggtgctcgatttagcactcgcacgttgggtttgggggagtcagtctcagtcaggacacagcatggacatgagggtccccgctcagctcctggggctcctgctactctggctccgaggtgccaaatgtgacatccagatgacccagtctccatcctccctgtctgcatctgtaggagacagagtcaccatcacttgccgggcaagtcagagcattaccaactatttgaattggtatcaacaaaaaccagggagagcccctcacctccttatctatggtgcatccaccttacaaagtggggtcccatcaaggttcagtggcactggatctgggacagatttcactctcaccatcagcagtctgcaacctgaagattttgcaacttattactgtcaacagagtttcagtacgcggacgttcggccaagggaccaaggtaggaagtacaaacgaactgtaggctgcaccatctgtcttcatcttccccg

SEQ ID NO: 587890 - DNA, 493 bp, Homo sapiens; identical to SEQ ID NO: 540880
  misc_feature: HIJSMM301BA63F.40.81.H04.1.454.light.4.raw

SEQ ID NO: 587891 - DNA, 487 bp, Homo sapiens; identical to SEQ ID NO: 536536
  misc_feature: HIJSMM301EQPPL.26.45.E01.1.454.light.4.raw

SEQ ID NO: 587892 - DNA, 447 bp, Homo sapiens; identical to SEQ ID NO: 535020
  misc_feature: HIJSMM301B2E8J.18.9.A09.1.454.light.4.raw

SEQ ID NO: 587893 - DNA, 502 bp, Homo sapiens
  misc_feature: HIJSMM301CM1R0.22.14.B03.1.454.light.4.raw
  modified_base (404)..(404): a, c, t, g, unknown or other
acatacgcgtcacgaccggtgctcgatttagtgtgagtagttccgcgggggagctacaacaggcaggcaggggcagcaagatggtgttgcagacccaggtcttcatttctctgttgctctggatctctggtgcctacggggacattgtgatgacccagtctccagactccctggctgtgtctctgggcgagagggccaccatcaactgcaagtccagccagagttattttttacagctccaccaataagagttacttagcttggttccagcagaaaccaggacatcgtcctgcactgctcatttactgggcgtctacccgggaatccggggtccctgaccgattcagtggcagcgggtctgggacagatttcactctcaccatcagcagcctgcaggctgaagntgtggctagtttattattgtcagcaattattatattcctcctcagtacgttcggccaagggaccaaggtggaaatcaaacgaactgtggctgcaccta

SEQ ID NO: 587894 - DNA, 498 bp, Homo sapiens; identical to SEQ ID NO: 538056
  misc_feature: HIJSMM301B7ENE.15.25.C03.1.454.light.4.raw

SEQ ID NO: 587895 - DNA, 492 bp, Homo sapiens
  misc_feature: HIJSMM301DMVI7.51.45.E01.1.454.light.4.raw
cgatcgtatacacgaccggtgctcgatttagtgagtcagtaagggaaaggggtgatcaggactcctcagttcaccttctcacaatgaggctccctgctcagctcctggggctgctaatgctctgggtctctggatccagtggggatattgtcatgactcagtctccactctccctgcccgtcacccctggagagccggcctccatctcctgcaggtctagtcagagcctcctccataatagtggattcttctatttggattggtacgtgctgaagccagggcagtctccacaactcctgatctatttgcgttctaatcgggcctccggggtccctgacaggttcagtggcagtggatcaggcacagattttacactgacaatcaacagagtggaggctgaggatgttggggtttattactgcgtgcaaagtctgcaaactatcaccttcggccaagggacacgactggagattaacgaactgtggctgcaca

SEQ ID NO: 587896 - DNA, 472 bp, Homo sapiens; identical to SEQ ID NO: 535898
  misc_feature: HIJSMM301ERUF7.15.8.A08.1.454.light.4.raw

SEQ ID NO: 587897 - DNA, 384 bp, Homo sapiens
  misc_feature: HIJSMM301BRDU2.41.34.D01.1.454.light.4.raw
tctatactatcacgaccggtgctcgatttagatcgtctgtgttgggtttgggggaaagagccaccctctcctgcagggccagtgagacagttactggtcaattacttagcctggtaccagcagaagcctggccaggctcccaggctcctcatctctgctgcctcctacagggccactggcatcccagacaggttcagtggcagtgggtctgggacagacttcactctctccatcagcagactggagcctgaagattttgcaatttattactgtcaccagtatggtagttcacctctaactttcggcggagggaccaaggtggagatcaaacgaactgtggctgcaccatctgtcttcatcttcccgccatctgaatagtataga

SEQ ID NO: 587898 - DNA, 485 bp, Homo sapiens; identical to SEQ ID NO: 535985
  misc_feature: HIJSMM301EWHHC.15.1.A01.1.454.light.4.raw

SEQ ID NO: 587899 - DNA, 501 bp, Homo sapiens; identical to SEQ ID NO: 535873
  misc_feature: HIJSMM301DPMF3.17.27.C05.1.454.light.4.raw

SEQ ID NO: 587900 - DNA, 494 bp, Homo sapiens; identical to SEQ ID NO: 535276
  misc_feature: HIJSMM301ADEX1.16.6.A06.1.454.light.4.raw

SEQ ID NO: 587901 - DNA, 489 bp, Homo sapiens
  misc_feature: HIJSMM301BJ0KU.49.66.F11.1.454.light.4.raw
agtcgagagacacgaccggtgctcgatttagtcacgcgagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccatctgt

SEQ ID NO: 587902 - DNA, 501 bp, Homo sapiens
  misc_feature: HIJSMM301C82GM.48.24.C02.1.454.light.4.raw
agtatacatacacgaccggtgctcgatttagtacagatcgttagggaaagggggaggttctttctctgggatgtggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagttacgtcggaccttggccaagggacacgactggagattaaacgaactgtggctgcacc

SEQ ID NO: 587903 - DNA, 503 bp, Homo sapiens
  misc_feature: HIJSMM301D810N.49.84.H07.1.454.light.4.raw
agtcgagagacacgaccggtgctcgatttagcagacgtctgtcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtgatagtggccgaagggtgttcggcggagggaccaaggtgaccggtcctaggtcagcccaaggctgccccctggt

SEQ ID NO: 587904 - DNA, 447 bp, Homo sapiens; identical to SEQ ID NO: 535020
  misc_feature: HIJSMM301DFHFI.18.9.A09.1.454.light.4.raw

SEQ ID NO: 587905 - DNA, 494 bp, Homo sapiens; identical to SEQ ID NO: 534994
  misc_feature: HIJSMM301DDBYS.27.78.H01.1.454.light.4.raw

SEQ ID NO: 587906 - DNA, 525 bp, Homo sapiens
  misc_feature: HIJSMM301AG6A2.8.38.D05.1.454.light.4.raw
  modified_base (509)..(509): a, c, t, g, unknown or other
ctcgcgtgtccacgaccggtgctcgatttagtatctgatagttgggtttgggggaggaactgctcagttaggacccagagggaaccatggaagccccagctcagcttctcttcctcctgctactctggctcccagataccaccggagagattgtgttgacacagtctccagccaccctgtctttgtctccaggggaaagagccaccctctcctgcagggccagtcagagtgttaccacccagttagcctggtaccaacacaaacctggccaggctcccaggcccctcatctttgatgcatccatcagggccactggcatcccagccaggttcagtggcagtgggtctgggacagacttcactctcaccatcagcagcctagagcctgaagattttgcagtttattactgtcaacatcgtaccgagtggcctccgggggccactttcggccctcggaccgaaaactaagtagaatcaaacgaaacgtacgtaggcgtgcaccaactactntcttctactcttccgt

SEQ ID NO: 587907 - DNA, 494 bp, Homo sapiens; identical to SEQ ID NO: 540645
  misc_feature: HIJSMM301DGL7T.13.38.D05.1.454.light.4.raw

SEQ ID NO: 587908 - DNA, 490 bp, Homo sapiens
  misc_feature: HIJSMM301BF7A2.51.22.B11.1.454.light.4.raw
cgatcgtatacacgaccggtgctcgatttagacgacagctcaggggttcagctgcgggtagagaagacaggactcaggacaatctccagcatggcctggtcccctctcttcctcaccctcatcactcactgtgcagggtcctgggcccagtctgtgctgactcaaccaccctcggtgtctgaagcccccaggcagagggtcaccatctcctgttctggaagcaactccaacatcggaaataatggtgtaaactggtaccagcaactcccaggaaaggctcccaaactcctcatctattatgatgatctgctgccctcaggggtctctgaccgattctctggctccaagtctggcacctcagcctccctggccatcagtggcctccagtctgaggatgagggtgattattactgtgcagcatgggatgacagcctgaatggggccctgttcggcggagggaccaagctgaccgtcctaagtcagcccaagg

SEQ ID NO: 587909 - DNA, 496 bp, Homo sapiens
  misc_feature: HIJSMM301DLGSX.7.5.A05.1.454.light.4.raw
cgtgtctctacacgaccggtgctcgatttagatagatagacaggggggggtctcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcagggtttccaatcgcttctctggctccaagtctggcgacacggcctccctgaccatctctgggctccaggctgaagacgaggctgattattactgcagctcatatacaggcagcagcactcaggttttcggcggagggaccaagctgaccgtcctaggtcagcccaaggctgccccctcggt

SEQ ID NO: 587910 - DNA, 504 bp, Homo sapiens; identical to SEQ ID NO: 573904
  misc_feature: HIJSMM301A19AF.18.37.D04.1.454.light.4.raw

SEQ ID NO: 587911 - DNA, 517 bp, Homo sapiens
  misc_feature: HIJSMM301C3DQ5.43.23.C01.1.454.light.4.raw
tgtgagtagtcacgaccggtgctcgatttagtacacgtgattagggattggggggcgccaggggtcccttccaatatcagcaccatggcctggactcctctctttctgttcctcctcacttgctgcccagggtccagttctcagactgtggtgactcaggagccctcactgactgtgtccccaggagggacagtcactctcacctgtgctttggtggctggaccagtcaccagtgcttaccatccaaactggttccagcagaagcctggacaaggccccacggcactgatttatggtgcgactaacaaacactcctggacccctgcccggttttcaggctccctcctcgggggcaaagctgccctgacactgtcaggtgtgcagcctgaggacgaggctgactattactgcctgctcatatatggtggcgcgtgggtgttcggcggagggaccaagctgaccgtcctgggtcagcccaaggctgccccctcggtcactctgttcccaccctcctcta

SEQ ID NO: 587912 - DNA, 494 bp, Homo sapiens
  misc_feature: HIJSMM301CBZU6.22.86.H09.1.454.light.4.raw
acatacgcgtcacgaccggtgctcgatttagtgctatagacttgggtttgggaggagagacccctcccctgggctctgctcctcctcagcctcctcactcagggcacaggatcctgggctcagtctgccctgactcagcctcgctcagtgtccgggtctcctggacagtcagtcaccatctcctacactggaaccagcagtgatgttggtggttataactatgtctcctggtaccaacagcacccaggcaaagcccccagactcatcatttatgctgtcaataagcggccctcaggggtccctgatcgcttctctggctccaagtctggcaacacggcctccctgaccatctctgggctccaggctgaagatgaggctgattattactgctgctcatttgcaggcgcctacacttgggtgttcggcggagggaccaagctgaccgtccaggtcagcccaaggctgccccctggtcactctgttcccacctcctc

SEQ ID NO: 587913 - DNA, 491 bp, Homo sapiens
  misc_feature: HIJSMM301C0PXU.3.72.G06.1.454.light.4.raw
agacgcactccacgaccggtgctcgatttagctacgactgcaagggaaagggggaggaactgctcagttaggacccagagggaaccatggaagccccagctcagcttctcttcctcctgctactctggctcccagatacaaccggagaaattgtgttgacacagtctccagccaccctgtctttgtctccaggggaaagagccactctctcctgcagggccagtcagagtgttagcagctacttagcctggtaccagcagaaacctggccaggctcccaggctcctcatttatgatgcatccaacagggccactggcatcccagccaggttcagtggcagtgggtctgggacaggcttcactctcaccatcagcagcctagagcctgaagattttgcagtttattactgtcagcagcgtagcaactggcctctcaccttcggcggagggaccaaggtggagatcaaacgaactgtggctgcaccatctgtt

SEQ ID NO: 587914 - DNA, 447 bp, Homo sapiens
  misc_feature: HIJSMM301EXM99.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttccccaccctccccactactcta

SEQ ID NO: 587915 - DNA, 486 bp, Homo sapiens
  misc_feature: HIJSMM301DVLM7.46.35.D02.1.454.light.4.raw
  modified_base (480)..(480): a, c, t, g, unknown or other
actagcagtacacgaccggtgctcgatttagcacacgatagttgggtttggggagctgctcagttaggacccagagggaaccatggaaaccccacgcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccaagaacttttggccagggaccgaagctggagatcaaacgaactgtggctncaccat

SEQ ID NO: 587916 - DNA, 490 bp, Homo sapiens; identical to SEQ ID NO: 536746
  misc_feature: HIJSMM301A4MAO.17.21.B10.1.454.light.4.raw

SEQ ID NO: 587917 - DNA, 494 bp, Homo sapiens; identical to SEQ ID NO: 549057
  misc_feature: HIJSMM301ANX4N.10.33.C11.1.454.light.4.raw

SEQ ID NO: 587918 - DNA, 492 bp, Homo sapiens; identical to SEQ ID NO: 560159
  misc_feature: HIJSMM301BVIQ5.46.67.G01.1.454.light.4.raw

SEQ ID NO: 587919 - DNA, 507 bp, Homo sapiens; identical to SEQ ID NO: 567918
  misc_feature: HIJSMM301B0HYM.4.10.A10.1.454.light.4.raw

SEQ ID NO: 587920 - DNA, 482 bp, Homo sapiens
  misc_feature: HIJSMM301CNSYR.48.19.B08.1.454.light.4.raw
agtatacatacacgaccggtgctcgatttagtgagtcagtaagggggctggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacttgggtgttcggcggagggaccaaggctgaccgtcctaggtcacg

SEQ ID NO: 587921 - DNA, 489 bp, Homo sapiens; identical to SEQ ID NO: 535139
  misc_feature: HIJSMM301AVRC2.14.55.E11.1.454.light.4.raw

SEQ ID NO: 587922 - DNA, 497 bp, Homo sapiens; identical to SEQ ID NO: 564836
  misc_feature: HIJSMM301E2KWL.16.78.H01.1.454.light.4.raw

SEQ ID NO: 587923 - DNA, 480 bp, Homo sapiens
  misc_feature: HIJSMM301BWCGL.19.71.G05.1.454.light.4.raw
  modified_base (419)..(419): a, c, t, g, unknown or other
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatcgaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtgcagtttntattgtcaacaattatattatacttcgtgacgttcgcaaggaccaagtggatatcagcgaa

SEQ ID NO: 587924 - DNA, 494 bp, Homo sapiens
  misc_feature: HIJSMM301E3EXB.47.78.H01.1.454.light.4.raw
agctcacgtacacgaccggtgctcgatttagtgtgagtagtttgggtttggggtgatcaggactcctcagttcaccttctcacaatgaggctccctgctcagctcctggggctgctaatgctctgggtcccagatccagtggggatgttgtgatgactcagtctccactctccctgtccgtcacccttgcacagccggcctccatctcctgttggtctggtcaaggcctcgaatacagtgatggaaacacctgcttgaattgctttcaccagaggccaggcccatctccaaggcgcctaatttataagctttctaaccgggactctggggtcccagacagattcagcggcagtggcactgatgtcacactgacaatcagcagggtggaggctgaggatgttggggtttgttcctccatgcaaggtacacactggccttttggccaggggaccaaccgtggagatcaaatgaactgtggctgcaccatctgtctt

SEQ ID NO: 587925 - DNA, 491 bp, Homo sapiens; identical to SEQ ID NO: 566034
  misc_feature: HIJSMM301BNZG5.17.21.B10.1.454.light.4.raw

SEQ ID NO: 587926 - DNA, 502 bp, Homo sapiens
  misc_feature: HIJSMM301AH8BL.53.33.C11.1.454.light.4.raw
cgcgtatacacacgaccggtgctcgatttagagtgagctcgttgggtttgggggctgtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaagaaaatatgcttattggtaccagcagaggtcaggccaggcccctgtgctggtcatctatgaggacaccaaacgaccctccgggatccctgcgagattctctggcgccagctcagggacagtggccaccctgacagtcagtggggcccaggtggaggatgaagctgattactactgttactcaacagacaggagtggaaatcatagggtattcggcggagggaccaaactgaccgtcctaggtcagcccaaggctgccccctcggtctac

SEQ ID NO: 587927 - DNA, 495 bp, Homo sapiens; identical to SEQ ID NO: 558764
  misc_feature: HIJSMM301DBQWH.43.82.H05.1.454.light.4.raw

SEQ ID NO: 587928 - DNA, 515 bp, Homo sapiens
  misc_feature: HIJSMM301CBQP7.52.35.D02.1.454.light.4.raw
cgcagtacgacacgaccggtgctcgatttagcacacgatagttgggtttgggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggatccagcagtgacgttggtgcttatgactttgtctcctggtaccaacaccaccctggcaaagcccccaaactcatcatttttgaggtcactaagcggccctcaggggtccctgatcgcttctctggctcgaagtctggcaacacggcctccctgaccgtctctgggctccaggctgaggatgaggctgattacactgcacctcatatgcaggcgacaacaatttggggttttcggcggagggaccaaggtgaccgtcctacgtcagcccaaggctgccccctcggtcactctgtt

SEQ ID NO: 587929 - DNA, 460 bp, Homo sapiens
  misc_feature: HIJSMM301DC1EQ.51.47.E03.1.454.light.4.raw
cgatcgtatacacgaccggtgctcgatttagactcgcgcacagagagaaggggtgggcctcaggaagcagcatcggaggtgcctcagccatggcatggatccctctcttcctcggcgtccttgcttactgcacaggatccgtggcctcctatgaactgactcagccaccctcagtgtccgtgtccccaggacagacagcgaccatcacctgttctggagacagattgactgataaatatgctggctggtatcggcagaagccaggccagtcccctgtgttggtcatctatcaggataccaagcggccctcagggatccctgagcgattctctggctccaactctgggaacacagccactctgaccatcagcgggactcaggctatcgatgaggctgactattactgtcaggcgtgggacagccgcactggggtattcggcggagggaccaagctgaccgt

SEQ ID NO: 587930 - DNA, 470 bp, Homo sapiens; identical to SEQ ID NO: 536130
  misc_feature: HIJSMM301C9X4O.7.81.H04.1.454.light.4.raw

SEQ ID NO: 587931 - DNA, 503 bp, Homo sapiens; identical to SEQ ID NO: 548067
  misc_feature: HIJSMM301AVZXZ.9.53.E09.1.454.light.4.raw

SEQ ID NO: 587932 - DNA, 527 bp, Homo sapiens
  misc_feature: HIJSMM301B7VA5.49.7.A07.1.454.light.4.raw
agtcgagagacacgaccggtgctcgatttagcacgtgtcgcaggggagtctgggcctaaggaagcagcactggtggtgcctcagccatggcctggaccgttctcctcctcggcctcctctctcactgcacagactctgtgacctcctatgtgttgacgcagccaccctcggtgtccgtggccccaggacagacggccaggtttccctgtgagggcaacaacattggtggtaaaggtgtgcactggtaccagcagaagccaggccaggcccctgtgttggtcgtccatgatgacagcgaccggccctcagggatccctgagcgattttctggctccaagtctgggaacacggccaccctgaccgtcagcagggtcgaagccggggatgaggccgactatatctgtcaggtgtgggatagtagtagtgctcgttccgggggtgttcggcggagggaccaagttgaccgtcgttggtcagcccaaggctcgccccctcggtcactctcgttcccaccctcctctctctcg

SEQ ID NO: 587933 - DNA, 500 bp, Homo sapiens
  misc_feature: HIJSMM301C6FM2.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgcgtcagcccagctgccccctcggtcactc

SEQ ID NO: 587934 - DNA, 503 bp, Homo sapiens
  misc_feature: HIJSMM301DXSSA.40.27.C05.1.454.light.4.raw
tctagcgactcacgaccggtgctcgatttagacgcgatcgaagggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctccctgaccatctctgggctccagactgaggatgaggctacttatttttgctgctcttatgcaggcagtttcgctctcgaagtgttcggcggagggaccgagctgaccgtcctacgtcggcccaaggctgccccctcc

SEQ ID NO: 587935 - DNA, 521 bp, Homo sapiens; identical to SEQ ID NO: 539470
  misc_feature: HIJSMM301BX4PX.27.23.C01.1.454.light.4.raw

SEQ ID NO: 587936 - DNA, 500 bp, Homo sapiens
  misc_feature: HIJSMM301CUCC9.15.1.A01.1.454.light.4.raw
tctacgtagccacgaccggtgctcgatttagacgtctcatcaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggagggaccaagctgaccgtcctgctcagcccaaggctgccccctcggtcact

SEQ ID NO: 587937 - DNA, 525 bp, Homo sapiens
  misc_feature: HIJSMM301DDVXO.7.86.H09.1.454.light.4.raw
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctggggggagagccaccctctcctgcagggccagtgaaccttttagtagtagttatttagcctggtatcggacaaaaacctggccaggcctccccgactcctctttctttggtggagcctacagggccactggccaccccagacaggatcagtggcagcgggtctgggacagacttcattctcaccatcaacagactgcagcctgaagatattgctagtttactactgtcagcagtatgttacgtccccgtggacgttcggccaagggaccaaggtggcaatcaaccgaactgtggctgcaccatctgttcttcatccttccccg

SEQ ID NO: 587938 - DNA, 495 bp, Homo sapiens; identical to SEQ ID NO: 536931
  misc_feature: HIJSMM301EKN5T.10.33.C11.1.454.light.4.raw

SEQ ID NO: 587939 - DNA, 489 bp, Homo sapiens; identical to SEQ ID NO: 542689
  misc_feature: HIJSMM301DA5ZT.4.64.F09.1.454.light.4.raw

SEQ ID NO: 587940 - DNA, 475 bp, Homo sapiens
  misc_feature: HIJSMM301C8239.13.76.G10.1.454.light.4.raw
tcacgtactacacgaccggtgctcgatttagtcactcatacaggggagcctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaactcagccactctgaccatcagcgggacccaggctatggatgaggctgactattactgtcaggcgtgggacagcagcacgtgcccgctatgtcttcggaactgggaccaaggtcaccgtcctaagtcacg

SEQ ID NO: 587941 - DNA, 491 bp, Homo sapiens; identical to SEQ ID NO: 535194
  misc_feature: HIJSMM301DUI2H.26.78.H01.1.454.light.4.raw

SEQ ID NO: 587942 - DNA, 488 bp, Homo sapiens; identical to SEQ ID NO: 535081
  misc_feature: HIJSMM301A0ZBZ.26.23.C01.1.454.light.4.raw

SEQ ID NO: 587943 - DNA, 488 bp, Homo sapiens; identical to SEQ ID NO: 542120
  misc_feature: HIJSMM301AK8IB.47.38.D05.1.454.light.4.raw

SEQ ID NO: 587944 - DNA, 495 bp, Homo sapiens
  misc_feature: HIJSMM301C1FN3.41.38.D05.1.454.light.4.raw
tctatactatcacgaccggtgctcgatttagtatctgatagttgggttggggaggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttattatggatcatccagtttacaaagtggggtcccatcaaggttcagcggcagtggatctgggacacatttcactctcactatcagcagcctgcagcctgaggtattttgcgacttactattgtcaacaggctgactagtttccctctctactttcggcggagggaccaaggtggagatacaaacgaactgtggctgcaccatctgtctt

SEQ ID NO: 587945 - DNA, 454 bp, Homo sapiens; identical to SEQ ID NO: 536846
  misc_feature: HIJSMM301CIDQ3.18.78.H01.1.454.light.4.raw

SEQ ID NO: 587946 - DNA, 499 bp, Homo sapiens
  misc_feature: HIJSMM301B1M7Z.40.9.A09.1.454.light.4.raw
tctagcgactcacgaccggtgctcgatttagcgagacgcgcagggggagctacaacaggcaggcaggggcagcaagatggtgttgcagacccaggtcttcatttttctgttgctctggatctctggtgcctacggggacatcgtgatgacccagtctccagactccctggctgtgtctctgggcgagagggccaccatcaactgcaagtccagccagagtcttttatacaactccaacaagcagcactacttagcttggtaccagcagaaaccaggacagcctcctaaactgctcatttactgggcctctacccgggaatccggggtccctgaccgattcagtggcagcgggtctgggacagatttcactctgaccatcagcagcctgcaggctgaagatgtggcagtttattactgtcaacaatattatattattccgaggacgttcggccaagggaccaaggtggaaatcaaacgaactgtggctgcaccatctgtt

SEQ ID NO: 587947 - DNA, 506 bp, Homo sapiens; identical to SEQ ID NO: 536355
  misc_feature: HIJSMM301DUG9C.47.85.H08.1.454.light.4.raw

SEQ ID NO: 587948 - DNA, 507 bp, Homo sapiens; identical to SEQ ID NO: 535641
  misc_feature: HIJSMM301ECP71.10.88.H11.1.454.light.4.raw

SEQ ID NO: 587949 - DNA, 495 bp, Homo sapiens; identical to SEQ ID NO: 547141
  misc_feature: HIJSMM301EMO11.9.1.A01.1.454.light.4.raw

SEQ ID NO: 587950 - DNA, 504 bp, Homo sapiens; identical to SEQ ID NO: 539091
  misc_feature: HIJSMM301D61F0.8.28.C06.1.454.light.4.raw

SEQ ID NO: 587951 - DNA, 509 bp, Homo sapiens
  misc_feature: HIJSMM301A4JJR.10.71.G05.1.454.light.4.raw
  modified_base (463)..(463): a, c, t, g, unknown or other
catagtagtgcacgaccggtgctcgatttagtgtcgtcgcaagagagaggggggaggaactgctcagttaggacccagagggaaccatggaagccccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaaagattttgcagtttattactgtcagcagcgtgccactttcggcggaggtgcacttcgtcggaggaccggaaaanaagtaagtacgaaacgaaacgtaagtggtcgtcgcgaccaactact

SEQ ID NO: 587952 - DNA, 505 bp, Homo sapiens
  misc_feature: HIJSMM301DB39U.8.38.D05.1.454.light.4.raw
ctcgcgtgtccacgaccggtgctcgatttagtatctgatagttgggtttgggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgcc

SEQ ID NO: 587953 - DNA, 494 bp, Homo sapiens; identical to SEQ ID NO: 536974
  misc_feature: HIJSMM301CIROF.16.86.H09.1.454.light.4.raw

SEQ ID NO: 587954 - DNA, 494 bp, Homo sapiens; identical to SEQ ID NO: 534994
  misc_feature: HIJSMM301CK686.27.78.H01.1.454.light.4.raw

SEQ ID NO: 587955 - DNA, 496 bp, Homo sapiens
  misc_feature: HIJSMM301DVDON.26.12.B01.1.454.light.4.raw
agactatactcacgaccggtgctcgatttagtagtgtagattccgcggggagagctctggggaggaactgctcagtcaggacccagacggaaccatggaagccccagcgcagcttctcttcctcctgctactctggctcccagatattaccggaaaaataatgatgactcagtctccaggcaccctgtctgtgtctccaggggaaagagtcaccctctcctgcagggccagtcagagtgttagtaacaacttagcctggtaccagcagaaacctggccaggctcccaggctcctcatctctggtgcatccaccagggccactggtatcccggccagattcagtggcagggggtctgggacagaattcactctcaccatcaccagcctgcagtctgaagattttgcagtctattactgtcagcaatataattactggctctctttcggtcgggggaccaagctggagatcaaccgaactgtggctgcaccatctgtt

SEQ ID NO: 587956 - DNA, 521 bp, Homo sapiens; identical to SEQ ID NO: 539470
  misc_feature: HIJSMM301A7PPM.27.23.C01.1.454.light.4.raw

SEQ ID NO: 587957 - DNA, 354 bp, Homo sapiens; identical to SEQ ID NO: 535026
  misc_feature: HIJSMM301BVYLF.19.22.B11.1.454.light.4.raw

SEQ ID NO: 587958 - DNA, 495 bp, Homo sapiens; identical to SEQ ID NO: 537415
  misc_feature: HIJSMM301AZV6Q.4.27.C05.1.454.light.4.raw

SEQ ID NO: 587959 - DNA, 494 bp, Homo sapiens
  misc_feature: HIJSMM301A4OR0.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaaccccctaagctcctgatctatggtgcatccactttggaaagtggggtcccctcaaggttcagcggcagtggatctgggacagatttcactctcgccatcagcagcctgcagactgaagattttgctaactttattttgtcaacaggctaacacctttccccctctactttcggcggagggaccaaggtggagatcaagcgaactgtggctgcaccatctgtctt

SEQ ID NO: 587960 - DNA, 495 bp, Homo sapiens; identical to SEQ ID NO: 554164
  misc_feature: HIJSMM301A75NE.27.78.H01.1.454.light.4.raw

SEQ ID NO: 587961 - DNA, 516 bp, Homo sapiens
  misc_feature: HIJSMM301DMVAN.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagccccaaggctcgccccctcggtcactctgttcccaccctcct

SEQ ID NO: 587962 - DNA, 478 bp, Homo sapiens; identical to SEQ ID NO: 541761
  misc_feature: HIJSMM301C4PYM.22.59.F04.1.454.light.4.raw

SEQ ID NO: 587963 - DNA, 495 bp, Homo sapiens; identical to SEQ ID NO: 538269
  misc_feature: HIJSMM301BFUXV.9.1.A01.1.454.light.4.raw

SEQ ID NO: 587964 - DNA, 484 bp, Homo sapiens
  misc_feature: HIJSMM301DGMDE.13.59.F04.1.454.light.4.raw
tcacgtactacacgaccggtgctcgatttagtacacacacttagggattgggggcagaagcctctctcagtcaggacacagcatggacatgagggtccctgctcagctcctgggactcctgctgctctggctcccagataccagatgtgacatccagatgacccagtctccatcctccctgtctgcatctcttggagacagagtcaccgtcacttgccgggcgagtcacgacattaacacttatttagcctggtatcagcagaagccagggagagtccctaaattattgatctctgctgcgtccgccttgcaatcgggggtcccatctcggttcagtggcggtggatctaggacagaattcactctcaccatcaccaacctgcaccctgaagatgttggaagttattactgtcagacctatagtggtggcccgctcattttcggcggagggaccaaggtgcagatcaaacgaactgtggctgca

SEQ ID NO: 587965 - DNA, 506 bp, Homo sapiens
  misc_feature: HIJSMM301A1YNB.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggccccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgctaacatgggatgacaatctgagcgggttgggtgttcggcggagggaccaaaactgaccgtcctaggtcagcccaa

SEQ ID NO: 587966 - DNA, 495 bp, Homo sapiens; identical to SEQ ID NO: 537716
  misc_feature: HIJSMM301DCZ6M.22.14.B03.1.454.light.4.raw

SEQ ID NO: 587967 - DNA, 503 bp, Homo sapiens; identical to SEQ ID NO: 582113
  misc_feature: HIJSMM301D4Z4A.48.71.G05.1.454.light.4.raw

SEQ ID NO: 587968 - DNA, 481 bp, Homo sapiens
  misc_feature: HIJSMM301BN6TY.7.76.G10.1.454.light.4.raw
cgtgtctctacacgaccggtgctcgatttagtcactcatacagggggcaggagtcagacccagtcaggacacagcatggacatgagggtccccgctcagctcctggggctcctgctgctctggttcccaggttccagatgcgacatccagatgacccagtctccatcttccgtgtctgcatctataggagacagagtcaccatcatttgtcgggcgagtcagcatattaccagccggttagcctggtatcagcagaaaccagggagagcccctaaactcctgatctctgctgcatccagtttacaaagtgggtcccatcgcggttcagcggcagtggatatgggacatatttcactctcgccatcagcagcctgcagcctgaagattttgcaacttactattgtcaacaggctaacagtttcccgctcaccttcggcgggggaccaaggtggagatcaaacgaactgtggctgcaccattc

SEQ ID NO: 587969 - DNA, 512 bp, Homo sapiens
  misc_feature: HIJSMM301APIK6.40.33.C11.1.454.light.4.raw
tctagcgactcacgaccggtgctcgatttagagtgagctcgttgggtttgggggaaaaggccctgaggaaaacaaaccccagctgggaagcctgagaacacttagccttcatgagtgtccccaccatggcctggatgatgcttctcctcggactccttgcttatggatcaggagtggattctcaggctgcggtgacccaagagccctcgttctcagtgtcccctggagggacagtcacactcacttgtggccggagctctggcgcagtctctcctgttcactaccccagctggtaccagcagaccccaggccagcctccacgttcactcatcgtcagcacaagcagacgtttgcctggggtgcctgatcgcttctctgcctccatccttgggaacaaagctgccctcaccattacgggggcccagccagaggatgagtcttattattactgcatgctccatgtggggggtgccgacttgggtgttcggcggagggaccaagctgaccgtccg

SEQ ID NO: 587970 - DNA, 494 bp, Homo sapiens
  misc_feature: HIJSMM301DMGCI.4.27.C05.1.454.light.4.raw
  modified_base (419)..(419): a, c, t, g, unknown or other
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgcgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtggganatgggcactgcgatcttcggcggagggaccaagctgaccgtcctgggtcagcccaaggctgccccctcggtcact

SEQ ID NO: 587971 - DNA, 494 bp, Homo sapiens; identical to SEQ ID NO: 534994
  misc_feature: HIJSMM301D22OW.27.78.H01.1.454.light.4.raw

SEQ ID NO: 587972 - DNA, 495 bp, Homo sapiens; identical to SEQ ID NO: 537415
  misc_feature: HIJSMM301D6FPX.4.27.C05.1.454.light.4.raw

SEQ ID NO: 587973 - DNA, 502 bp, Homo sapiens; identical to SEQ ID NO: 547307
  misc_feature: HIJSMM301BVRCG.47.55.E11.1.454.light.4.raw

SEQ ID NO: 587974 - DNA, 474 bp, Homo sapiens
  misc_feature: HIJSMM301DS296.5.12.B01.1.454.light.4.raw
atcagacacgcacgaccggtgctcgatttagtagtgtagattccggcggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccaacagtgacattggtgcttatgactatgtctcgtggtatcaaaagtatccagacacagcccccaaactcatcctttatgatgtccgtgttcggccctcaggggtttctgttcgcttctctggctccaagtctggcagcacggcctccctgaccatctctgggctccaggctgaggacgaggctgactattattgcagttcatatggtagtatgaagactcttgtgattttcggcggagggccaagctgaccgt

SEQ ID NO: 587975 - DNA, 486 bp, Homo sapiens; identical to SEQ ID NO: 535043
  misc_feature: HIJSMM301AZ4L1.46.35.D02.1.454.light.4.raw

SEQ ID NO: 587976 - DNA, 494 bp, Homo sapiens
  misc_feature: HIJSMM301CN55W.51.83.H06.1.454.light.4.raw
cgatcgtatacacgaccggtgctcgatttagatcacgtgcgtcgcgggggaggaactgctcagttaggacccagagggaaccatggaagccccagctcagcttctcttcctcctgctactctggctcccagatgccaccggacaaattgtgttgacacagtctccaggcaccctgtctttgtctccaggggaaagagccaccctctcctgcagggccagtcagagtgttagtcacttcttagcctggtaccaacacaaacctggccaggctcccaggctcctcatttatgatgcatccaagagggccactggcgtcccagccaggttcagtggcagtgggtctgggacagacttcactctcaccatcagcagcctagagcctgaagattttgcaatttattactgtcagcagcgtagcaattggcctccctcgatcaccttcggccaagggacacgactggagaataacgaactgtggctgcaccatctgtctt

SEQ ID NO: 587977 - DNA, 508 bp, Homo sapiens; identical to SEQ ID NO: 547688
  misc_feature: HIJSMM301CPGIN.48.31.C09.1.454.light.4.raw

SEQ ID NO: 587978 - DNA, 480 bp, Homo sapiens
  misc_feature: HIJSMM301BY5GI.13.50.E06.1.454.light.4.raw
tcacgtactacacgaccggtgctcgatttagatctactgacaacacacaagggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcggcagtgggtctgggacagacttcactctcaccatcagcagcctgcagtctgaagatttgcagtctattactgtcagcagtatagttactggagaaccttcggccaagggacacgactggagattaaaggaactgtggctgcac

SEQ ID NO: 587979 - DNA, 485 bp, Homo sapiens
  misc_feature: HIJSMM301ANTPO.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatggttggggtttattactgcatgcaagctctacaaactccgctcactttcggcggagggaccaaggtggagatcaaacgaa

SEQ ID NO: 587980 - DNA, 514 bp, Homo sapiens; identical to SEQ ID NO: 538541
  misc_feature: HIJSMM301A0PWM.47.23.C01.1.454.light.4.raw

SEQ ID NO: 587981 - DNA, 520 bp, Homo sapiens
  misc_feature: HIJSMM301CBBRR.27.23.C01.1.454.light.4.raw
  modified_base (508)..(508): a, c, t, g, unknown or other
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcacnctgttccgccct

SEQ ID NO: 587982 - DNA, 484 bp, Homo sapiens; identical to SEQ ID NO: 535400
  misc_feature: HIJSMM301ERH78.46.26.C04.1.454.light.4.raw

SEQ ID NO: 587983 - DNA, 521 bp, Homo sapiens
  misc_feature: HIJSMM301ETC18.7.86.H09.1.454.light.4.raw
  modified_base (210)..(210): a, c, t, g, unknown or other
cgtgtctctacacgaccggtgctcgatttagtgctatagacttgggtttggggagagctctggagaagagctgctcagttaggacccagagggaaccatggaaagcccagcgcagcttctcttcctcctgctactctggctcccagagacgaccggagagattgtattgacgcagtctccaaccaccctgtctttgtctcctgggggganagccaccctctcctgcagggccagtgaaccttttagtagttagttatttagcctggtatcggacaaaaacctggccaggctccccgactcctcttctttggtggagcctacagggccactggcaccccagacaggatcagtggcagcgggtctgggacagacttcattctcaccatcaaacagactgcagcctgaagatattgcagtttactactgtcagcagtatgttacgtccccgtggacgttcggccaagggaccaaggtggcaatcaaccgaactgtggctgcaccatctgtcttcatcttccccg

SEQ ID NO: 587984 - DNA, 489 bp, Homo sapiens
  misc_feature: HIJSMM301DOSEH.47.38.D05.1.454.light.4.raw
agctcacgtacacgaccggtgctcgatttagtatctgatagttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagccagagcctcttacatagtaatggattcaactatttgaattggtacctgcagaagccagggcagtctccacagctcctgatctgtttgggttctgatcgggcctccggggtccctgacaggttcagtggcagtggatcaggcacagattttacgctgaaaatcagtagggtggaggctgaggatgttggggtttattactgcatgcaagttctacaacttcctacacttttggccaggggaccaagctggagatcaaacgaactgtgg

SEQ ID NO: 587985 - DNA, 496 bp, Homo sapiens; identical to SEQ ID NO: 536802
  misc_feature: HIJSMM301AZXOM.5.24.C02.1.454.light.4.raw

SEQ ID NO: 587986 - DNA, 505 bp, Homo sapiens; identical to SEQ ID NO: 535503
  misc_feature: HIJSMM301BWZXA.8.28.C06.1.454.light.4.raw

SEQ ID NO: 587987 - DNA, 470 bp, Homo sapiens
  misc_feature: HIJSMM301ENQNI.49.8.A08.1.454.light.4.raw
agtcgagagacacgaccggtgctcgatttagcatactctacagggggcaggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaactgt

SEQ ID NO: 587988 - DNA, 482 bp, Homo sapiens
  misc_feature: HIJSMM301BURYL.48.19.B08.1.454.light.4.raw
agtatacatacacgaccggtgctcgatttagtgagtcagtaaggggggggtctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccatctctgggctccaggctgaggatgaggctgattattactgctgctcatatgcaggcagctacacgttgggtgttcggcggaggaccaagctgaccgtcctaggtcagcccaa

SEQ ID NO: 587989 - DNA, 486 bp, Homo sapiens; identical to SEQ ID NO: 535290
  misc_feature: HIJSMM301A4PZI.3.12.B01.1.454.light.4.raw

SEQ ID NO: 587990 - DNA, 517 bp, Homo sapiens; identical to SEQ ID NO: 553231
  misc_feature: HIJSMM301CM30F.22.30.C08.1.454.light.4.raw

SEQ ID NO: 587991 - DNA, 485 bp, Homo sapiens
  misc_feature: HIJSMM301EL8T0.43.24.C02.1.454.light.4.raw
tgtgagtagtcacgaccggtgctcgatttagtacagatcgttagggaaaggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatagaaacaactatttggattggtatctgcagaagccagggcagcctccacagctcctgatctatttgggttctaatcgggcctccggggtccctgacaggttcagtggcagtggatcaggcacagattttacactgaaaatcagcagagtggaggctgaggatgttggggtttattactgtcatgcaagctctacaaactccgctcactttcggcggagggaccaaggtggagatcaaacgaa

SEQ ID NO: 587992 - DNA, 486 bp, Homo sapiens; identical to SEQ ID NO: 586790
  misc_feature: HIJSMM301CFQMQ.47.46.E02.1.454.light.4.raw

SEQ ID NO: 587993 - DNA, 496 bp, Homo sapiens; identical to SEQ ID NO: 558251
  misc_feature: HIJSMM301BGBW3.16.78.H01.1.454.light.4.raw

SEQ ID NO: 587994 - DNA, 507 bp, Homo sapiens
  misc_feature: HIJSMM301AEG4I.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacacgacttacaatataccgaggacgttcggtcaagggaccaaggtggagatacaacgaactagtggctgcaccatctgtcttcatcttcccgccat

SEQ ID NO: 587995 - DNA, 519 bp, Homo sapiens
  misc_feature: HIJSMM301C53H8.48.41.D08.1.454.light.4.raw
agtatacatacacgaccggtgctcgatttagtcacgcgagaaagggaaaggggctgggcctaaggaagcagcactggtggtgcctcagccatggcctggaccgttctcctcctcggcctcctctctcactgcacaggctctgtgacctcctatgttctgactcagccaccctcggtgtcagtggccccaggaaagacggccaggattacctgtggaggaaacaacattggaagtaaaagtgtgcactggtaccagcagaagccaggccaggcccctgtgctggtcgtctttgatgataccgaccggccctcagggatccctgagcgattctctggctccaactctgtgaacacggccaccctgaccatcagcagggtcgaagccggggatgaggccgactattactgtcaggtgtgggatagtagtagtgatcatcctaattgggtgttcggcggagggaccaagctgaccgtcctaggtcagcccaaggctgccccctcggtcactctgttcccgcct

SEQ ID NO: 587996 - DNA, 501 bp, Homo sapiens
  misc_feature: HIJSMM301E2EBH.4.27.C05.1.454.light.4.raw
agcactgtagcacgaccggtgctcgatttagacgcgatcgaagggtttggggctgggcctcaggaagcagcatcggaggtgcctcagccatggcatggatccctctcttcctcggcgtccttgcttactgcacaggatgtgtgacctcttatgagctgactcagccaccctcactgtccgtgtccccaggacagacagccaccattacctgctctggaaatgaattggcagataagtttgtgtgttggtatcaagtgaggccaggccagtcccctcttttagtcatgtatcgggatagaaagcggccctcagggatccctgagcgcttctctggatccaactctgggaacacagccactctgaccatcagcgggacccaacttttagatgaggccgactatttctgtcacacgtgggacatgggcactgcgatcttcggcggagggaccgaaagctgaccgtcctcgggtcgagcccaacggctcgccccctccggtcact

SEQ ID NO: 587997 - DNA, 447 bp, Homo sapiens; identical to SEQ ID NO: 549542
  misc_feature: HIJSMM301AWTRI.18.9.A09.1.454.light.4.raw

SEQ ID NO: 587998 - DNA, 496 bp, Homo sapiens; identical to SEQ ID NO: 573952
  misc_feature: HIJSMM301CNUW8.16.78.H01.1.454.light.4.raw

SEQ ID NO: 587999 - DNA, 511 bp, Homo sapiens; identical to SEQ ID NO: 548439
  misc_feature: HIJSMM301DCEV1.16.46.E02.1.454.light.4.raw

SEQ ID NO: 588000 - DNA, 475 bp, Homo sapiens
  misc_feature: HIJSMM301A1YCI.52.59.F04.1.454.light.4.raw
cgcagtacgacacgaccggtgctcgatttagtacacacacttagggattggggaagtctctctcagccaggacacagcatggacatgagggtccctgctcagctcctgggactcctgctgctctggctcccagataccagatgtgacatccagatgacccagtctccatcctccctgtctgcatctgttggagacagagtcaccatctcttgccgggcgagtcaggtcattaacagttatttagcctggtatcagcaaaaaccagggcaagttcctgaactcctgatctatgacacatccactttgcaatcagggtcccatctcggttcgttggcagtgggtctgggacagattttactctcaccatcagcagcctgcagcctgaagatgttgcaacttatttctgtcataactatgatgatgcccctcacacgttcggccaagggaccaagctggaaatcaaacgaactagtgg

SEQ ID NO: 588001 - DNA, 504 bp, Homo sapiens; identical to SEQ ID NO: 538521
  misc_feature: HIJSMM301DEC77.9.12.B01.1.454.light.4.raw

SEQ ID NO: 588002 - DNA, 510 bp, Homo sapiens; identical to SEQ ID NO: 545115
  misc_feature: HIJSMM301DFW7R.19.59.F04.1.454.light.4.raw

SEQ ID NO: 588003 - DNA, 503 bp, Homo sapiens
  misc_feature: HIJSMM301BEB5S.21.22.B11.1.454.light.4.raw
tcgtcgctcgcacgaccggtgctcgatttagacgacagctcaggggagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctccctgaccatcagtgggctccggtccgaggatgaggctgactattactgtgcatcacgggacgcaacatgggatgacaatctgagcggttgggtgttcggcggagggaccaaacgtgaccgtcctaggtcagcccaa

SEQ ID NO: 588004 - DNA, 467 bp, Homo sapiens
  misc_feature: HIJSMM301C5X6V.40.48.E04.1.454.light.4.raw
tctagcgactcacgaccggtgctcgatttagagagcgtcacagagagaagggcacgaccggtgctcgatttagtacacacacttagggattggggctgggcctcaggaagcagcatcggaggtgcctcagccatggcatggatccctctcttcctcggcgtccttgcttactgcacaggctccgtggcctcctatgacttgactcagccaccctcagtgtccgtgtccccaggacagacagccaccatcacctgttctggagatagattggcatataaatatgcttcctggtatcagcagaagccaggccagtcccctgtgctggtcatctatcaacataatcagcggccctcaggtattcctgagcgattctctggctccagttctgggaacacagccactctgaccatcagcgggaccccaggcctatggatgaggctgactattactgtcaggcgtgggacatc

SEQ ID NO: 588005 - DNA, 499 bp, Homo sapiens
  misc_feature: HIJSMM301E29RF.16.78.H01.1.454.light.4.raw
tgtactactccacgaccggtgctcgatttagtgtgagtagtttgggtttgggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtattagcagcaacttagcctggtaccagcagaaacctggccaggctcccaggctcctcatctatggtgcatccaccagggccactggtatcccagccaggttcagtggcagtgggtctgggacagagttcactctcaccatcagcagcctgcagtctgaagattttgcggtttattactgtcagcagtataataactggcctccacggtacactttggtccaggggaccgaagctggagatcaaacgaaactgtggctgcaccatctgtt

SEQ ID NO: 588006 - DNA, 444 bp, Homo sapiens; identical to SEQ ID NO: 535192
  misc_feature: HIJSMM301BI9P7.5.9.A09.1.454.light.4.raw

SEQ ID NO: 588007 - DNA, 484 bp, Homo sapiens; identical to SEQ ID NO: 535400
  misc_feature: HIJSMM301BB9CQ.46.26.C04.1.454.light.4.raw

SEQ ID NO: 588008 - DNA, 498 bp, Homo sapiens
  misc_feature: HIJSMM301CZOFR.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccagggctgaccgtcctgagtcagcccaaggctg

SEQ ID NO: 588009 - DNA, 494 bp, Homo sapiens; identical to SEQ ID NO: 534994
  misc_feature: HIJSMM301D51Z9.27.78.H01.1.454.light.4.raw

SEQ ID NO: 588010 - DNA, 512 bp, Homo sapiens
  misc_feature: HIJSMM301CANQM.43.19.B08.1.454.light.4.raw
tgtgagtagtcacgaccggtgctcgatttagtgagtcagtaaggggctgggcctaaggaagcagcactggtggtgcctcagccatggcctggaccgttctcctcctcggcctcctctctcactgcacagggtcggtgacttcctatgtgctgactcagccaccctcggtgtcagtggccccaggaaagacggccaggattacctgtgggggaaccaacattggaagaagaagtgtgcactggtaccagcagaagccaggccaaggcccctctgatgatcgtctatgatgatagcgaccggccctcagggatccctgagcgagtcgctggctccaactctggcaacacggccaccctggccatcagcagggtcgaagccggggatgaggccgactattactgtcaggtgtgggataatggtggtgatcatccggtcttcggcgagggaccaagttgaccgtcctaagtcagcccaaggctgccccctcggtcactctgttcccaccctcctca

SEQ ID NO: 588011 - DNA, 518 bp, Homo sapiens
  misc_feature: HIJSMM301BY5YH.22.30.C08.1.454.light.4.raw
acatacgcgtcacgaccggtgctcgatttagtctgacgtcaaagggaaagggggagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggagggaccaagctgaccgtcctaggtcagcccaaggctgccccctggtcactctgttcccaccctcctcacgcg

SEQ ID NO: 588012 - DNA, 488 bp, Homo sapiens; identical to SEQ ID NO: 535861
  misc_feature: HIJSMM301DMOYZ.14.55.E11.1.454.light.4.raw

SEQ ID NO: 588013 - DNA, 518 bp, Homo sapiens
  misc_feature: HIJSMM301DV5SN.9.38.D05.1.454.light.4.raw
tgatacgtctcacgaccggtgctcgatttagtatctgatagttgagtttgggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcctc

SEQ ID NO: 588014 - DNA, 503 bp, Homo sapiens; identical to SEQ ID NO: 538884
  misc_feature: HIJSMM301BURC5.27.78.H01.1.454.light.4.raw

SEQ ID NO: 588015 - DNA, 493 bp, Homo sapiens; identical to SEQ ID NO: 549967
  misc_feature: HIJSMM301DVIAM.10.20.B09.1.454.light.4.raw

SEQ ID NO: 588016 - DNA, 417 bp, Homo sapiens
  misc_feature: HIJSMM301BI1O8.16.46.E02.1.454.light.4.raw
tgtactactccacgaccggtgctcgatttagactcatctacagggaaagggggctgtgcctggggtctcctggacagtcagtcaccatctcctgcactggaaccagcagtgacgttggtagttataaccgtgtctcctggtaccagcagcccccaggcacagcccccaaactcatgatttatgaagtcagtaatcggccctcaggggtccctgatcgcttctctgggtccaagtctggcaacacggcctccctgaccatctctgggctccaggctgaggacgaggctgattattactgcagcttatatacaggcaacaatacttttgtcttcggaactgggaccaaggtcaccgtcctaggtcagcccaaggccaaccccactgtcactctcgttcccgccctcctcgagtagtaca

SEQ ID NO: 588017 - DNA, 495 bp, Homo sapiens
  misc_feature: HIJSMM301DFR87.22.27.C05.1.454.light.4.raw
  modified_base (442)..(442): a, c, t, g, unknown or other
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattccnccttcagacgttcggccaagggaccaaggtgaaatcaaacgactgtgctgcac

SEQ ID NO: 588018 - DNA, 488 bp, Homo sapiens; identical to SEQ ID NO: 559983
  misc_feature: HIJSMM301A8RLV.17.34.D01.1.454.light.4.raw

SEQ ID NO: 588019 - DNA, 488 bp, Homo sapiens; identical to SEQ ID NO: 537124
  misc_feature: HIJSMM301ESB1J.11.25.C03.1.454.light.4.raw

SEQ ID NO: 588020 - DNA, 522 bp, Homo sapiens
  misc_feature: HIJSMM301EXBQV.19.80.H03.1.454.light.4.raw
  modified_base (508)..(508): a, c, t, g, unknown or other
tactctcgtgcacgaccggtgctcgatttagctgtgcgtcgaagggaaaggggccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaagcggggacccagaccctggagcctcagttggaagcagccgatccagcctgcggagcctgtggggcaggtcagcccaaggcctgccccctcggtccactctcgttcccncccctcctcccacg

SEQ ID NO: 588021 - DNA, 512 bp, Homo sapiens
  misc_feature: HIJSMM301A0HZQ.14.85.H08.1.454.light.4.raw
cgtctagtaccacgaccggtgctcgatttagtatcactcagtcgcggggggggtcgtcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatatcctgcactggaaccagcagtgacgttggtgcttataactttgtctcctggtaccaacagcacccaggcaaagcccccaaactcatgatttatgacgtcaataagcggccctcgggggtccctgatcgcttctctggctccaagtctggcaacacggcctccctgaccgtctctgggctccaggctgacgatgaggctgattattactgcagctcacatgcagtcagtaacaatttcggggttttcggcggagggaccaagctgaccgtcctaagtcagcccaaggctgccccctcggtcactctcg

SEQ ID NO: 588022 - DNA, 521 bp, Homo sapiens; identical to SEQ ID NO: 538715
  misc_feature: HIJSMM301AVT84.27.23.C01.1.454.light.4.raw

SEQ ID NO: 588023 - DNA, 470 bp, Homo sapiens
  misc_feature: HIJSMM301D1P33.11.70.G04.1.454.light.4.raw
  modified_base (429)..(429): a, c, t, g, unknown or other
cgagagataccacgaccggtgctcgatttagtgtagtgtgaagggaaagggggcagaagtctctctcagtcaggacacagcatggacatgagggtccctgctcagctcctgggactcctgctgctctggctcccagatgccagatgtgacatccagttgacccagtctccatcctccctgtctgcatctgtgggagacagagtcaccatcacttgccgggcgagtcagggcattggcaattatttagcctggtatcagcagagaccagggaaacctcctaacctcctgatctttgctgcatccactctgcaatcaggggtcccatctcgattcagtggcagtggatctgggacagatttcactctcaccatcagcagcctgcagcctgaagatgttgcaacttattactgtacaaaagaataagcgctnccccgctcagtttcggcggagggaccaaggtggagataacg

SEQ ID NO: 588024 - DNA, 492 bp, Homo sapiens
  misc_feature: HIJSMM301B90PI.49.60.F05.1.454.light.4.raw
agtcgagagacacgaccggtgctcgatttagtacgtcatcagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcaactatttaaattggtatcaacataccccggggaaggcccctaggttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgtcttcta

SEQ ID NO: 588025 - DNA, 377 bp, Homo sapiens; identical to SEQ ID NO: 536071
  misc_feature: HIJSMM301ANB37.40.9.A09.1.454.light.4.raw

SEQ ID NO: 588026 - DNA, 486 bp, Homo sapiens; identical to SEQ ID NO: 535043
  misc_feature: HIJSMM301DHS80.46.35.D02.1.454.light.4.raw

SEQ ID NO: 588027 - DNA, 493 bp, Homo sapiens
  misc_feature: HIJSMM301BWDAR.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaacccgactgtcactc

SEQ ID NO: 588028 - DNA, 495 bp, Homo sapiens; identical to SEQ ID NO: 554198
  misc_feature: HIJSMM301BI43R.41.53.E09.1.454.light.4.raw

SEQ ID NO: 588029 - DNA, 507 bp, Homo sapiens; identical to SEQ ID NO: 563344
  misc_feature: HIJSMM301B99CW.3.79.H02.1.454.light.4.raw

SEQ ID NO: 588030 - DNA, 486 bp, Homo sapiens
  misc_feature: HIJSMM301E3O31.15.1.A01.1.454.light.4.raw
tctacgtagccacgaccggtgctcgatttagacgtctcatcagggcctgggctctgctgctcctcactctcctcactcaggacacagggtcctgggcccagtctgccctgactcggcctgcctccgtgtctgggtctcctggacagtcgatcaccatctcctgcactggaaccagcagtgatgttgggggttatcaccttgtctcctggtaccaacaccaccccggcagagcccccaaactcatgatttatgaggccactaagcgaccctcagggctttctaatcgcttctctggctccaagtctggcaacacggcctccctgacaatctctgggctccaggctgacgacgaggctaattattactgctgctcatatgaaggttataacactatactattcggcggaggggaccaagctgaccgtcctgcgtcagcccaaggctgccccctcggtcactctgttcccaccctcctcgctacgtaga

SEQ ID NO: 588031 - DNA, 495 bp, Homo sapiens; identical to SEQ ID NO: 543912
  misc_feature: HIJSMM301BPJU4.12.38.D05.1.454.light.4.raw

SEQ ID NO: 588032 - DNA, 497 bp, Homo sapiens; identical to SEQ ID NO: 536371
  misc_feature: HIJSMM301CQDJQ.16.78.H01.1.454.light.4.raw

SEQ ID NO: 588033 - DNA, 505 bp, Homo sapiens; identical to SEQ ID NO: 537876
  misc_feature: HIJSMM301ASYXN.5.68.G02.1.454.light.4.raw

SEQ ID NO: 588034 - DNA, 497 bp, Homo sapiens
  misc_feature: HIJSMM301CUXJR.3.33.C11.1.454.light.4.raw
agacgcactccacgaccggtgctcgatttagagtgagctcgttgggtttgggggctttgcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggctgccccctcggtcactctgttcccgccctcctcgagtcgcgtct

SEQ ID NO: 588035 - DNA, 510 bp, Homo sapiens; identical to SEQ ID NO: 574761
  misc_feature: HIJSMM301C83R4.8.34.D01.1.454.light.4.raw

SEQ ID NO: 588036 - DNA, 511 bp, Homo sapiens; identical to SEQ ID NO: 535945
  misc_feature: HIJSMM301B1TXF.43.23.C01.1.454.light.4.raw

SEQ ID NO: 588037 - DNA, 382 bp, Homo sapiens; identical to SEQ ID NO: 558348
  misc_feature: HIJSMM301D059B.48.26.C04.1.454.light.4.raw

SEQ ID NO: 588038 - DNA, 502 bp, Homo sapiens; identical to SEQ ID NO: 537339
  misc_feature: HIJSMM301BVFUF.19.85.H08.1.454.light.4.raw

SEQ ID NO: 588039 - DNA, 486 bp, Homo sapiens; identical to SEQ ID NO: 535043
  misc_feature: HIJSMM301BSX74.46.35.D02.1.454.light.4.raw

SEQ ID NO: 588040 - DNA, 460 bp, Homo sapiens; identical to SEQ ID NO: 539553
  misc_feature: HIJSMM301AED4E.11.86.H09.1.454.light.4.raw

SEQ ID NO: 588041 - DNA, 513 bp, Homo sapiens; identical to SEQ ID NO: 535719
  misc_feature: HIJSMM301B41KK.17.33.C11.1.454.light.4.raw

SEQ ID NO: 588042 - DNA, 486 bp, Homo sapiens
  misc_feature: HIJSMM301DRZ7C.51.30.C08.1.454.light.4.raw
cgatcgtatacacgaccggtgctcgatttagtctgacgtcaaagggaaagggggggcctcaggaagcagcatcggaggtgcctcagccatggcatggatccctctcttcctcggcgtccttgcttactgcacaggatttgtggcctcctatgagctgattcagccaccctcagtgtccgtgtccccaggacaaacagccagcatcacctgctctggagataaattgcgagataaatatgctgcctggtatcagcagaagccaggccagtcccctgtggtggtcatctatcaagacaccaagcggccctcggggatacctgagcgattctctggctccacctctgggaacacagccactctgaccatcagcgggacgcaggctgtggatgaggctgacttttactgtcaggcgtgggacagcgacactgccgtgttcggcggagggaccaagctgaccgtcctcggtcagcccaaggctgccccctc

SEQ ID NO: 588043 - DNA, 487 bp, Homo sapiens; identical to SEQ ID NO: 536986
  misc_feature: HIJSMM301DB6GL.3.12.B01.1.454.light.4.raw

SEQ ID NO: 588044 - DNA, 505 bp, Homo sapiens
  misc_feature: HIJSMM301CBLTP.9.71.G05.1.454.light.4.raw
tgatacgtctcacgaccggtgctcgatttagtgtcgtcgcaagagagagggggggggtcacaagaggcagcgctctcgggacgtctccaccatggcctgggctctgctgctcctcaccctcctcactcaggacacagggtcctgggccctgtctgccctgactcagcctgcctccgtgtctgggtctcctggacagtcgatcaccatctcctgcactggacccaccactgatattgggcattataaccttgtctcctggtatcaacaacgcccagacaaagcccccacactcttaatttatgaggtcactaagcggccctcaggggtttctggtcgcttctctgcctccaagtctggcaacacggcctccctgacaatctctgggctccagtctgacgacgaggctgattattactgcagctcatatgcagttggttcctctttcaagatattcggcggagggaccaggctgacccgtctgagtcagcccaaggctgtccccccg

SEQ ID NO: 588045 - DNA, 507 bp, Homo sapiens; identical to SEQ ID NO: 555714
  misc_feature: HIJSMM301CQRXW.40.67.G01.1.454.light.4.raw

SEQ ID NO: 588046 - DNA, 464 bp, Homo sapiens
  misc_feature: HIJSMM301CCKX5.48.59.F04.1.454.light.4.raw
agtatacatacacgaccggtgctcgatttagtacacacacttagggattggggagagctgctcagttaggacccagagggaaccatggaaaccccagcgcagcttctcttcctcctgctactctggctcccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagatttgcagtgtattactgtcagcagtatggtagctcaccgatcaccttggccaaggggacacgactggagattaaccgaactgtggctgcaccatctgtcttcatcttcccgccatctgatatgtatact

SEQ ID NO: 588047 - DNA, 488 bp, Homo sapiens; identical to SEQ ID NO: 538017
  misc_feature: HIJSMM301CQ7P8.4.59.F04.1.454.light.4.raw

SEQ ID NO: 588048 - DNA, 503 bp, Homo sapiens; identical to SEQ ID NO: 581000
  misc_feature: HIJSMM301BMP0T.53.37.D04.1.454.light.4.raw

SEQ ID NO: 588049 - DNA, 492 bp, Homo sapiens; identical to SEQ ID NO: 551006
  misc_feature: HIJSMM301EH4XA.41.16.B05.1.454.light.4.raw

SEQ ID NO: 588050 - DNA, 507 bp, Homo sapiens
  misc_feature: HIJSMM301AC86B.10.7.A07.1.454.light.4.raw
catagtagtgcacgaccggtgctcgatttagcacgtgtcgcagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtattaggagctccttagcctggtaccaacagaaatatggccaggctcccaggctcctcatctatgaaacatccaatagggccactgccatccctgccaggttcagtggcagtgggtctgggacaggacttcactctcatcatcagcggcctagagcctgaagattctgcagtttactactgtcagcaccgtaccgagtggcctccccaacccactttcggcggagggaccgaaggtggagatacaaacgaactagtggctgcaccatctgtcttcatcttccccg

SEQ ID NO: 588051 - DNA, 477 bp, Homo sapiens; identical to SEQ ID NO: 552384
  misc_feature: HIJSMM301DV1SE.16.86.H09.1.454.light.4.raw

SEQ ID NO: 588052 - DNA, 486 bp, Homo sapiens; identical to SEQ ID NO: 535458
  misc_feature: HIJSMM301CL8YX.7.75.G09.1.454.light.4.raw

SEQ ID NO: 588053 - DNA, 518 bp, Homo sapiens; identical to SEQ ID NO: 539372
  misc_feature: HIJSMM301D69O2.7.86.H09.1.454.light.4.raw

SEQ ID NO: 588054 - DNA, 517 bp, Homo sapiens; identical to SEQ ID NO: 541775
  misc_feature: HIJSMM301BFR4W.5.27.C05.1.454.light.4.raw

SEQ ID NO: 588055 - DNA, 482 bp, Homo sapiens
  misc_feature: HIJSMM301DT1O2.15.8.A08.1.454.light.4.raw
tctacgtagccacgaccggtgctcgatttagcatactctacagggtggctggagactgcgtcatcactacttctcttcctcctgctactctggctcccagataccactggagaagtagtgatgacgcagtctccagccaccctgtctgtgtctccgggggaaagagccaccctctcctgcagggccagtcagagagttgccgccagtttagcctggtaccaacagaaacctggccagcctcccaggctcctcatctatgctgcatccattagggacactggtatcccagccaggttcagtggcagtgggtctggcacagagttcactctcaccatcagcagcccgcagtctgaagtattttgcagtttattactgtcagcaatataacaagtggccattcactttcggcccagggaccaagtggatatcaaacgaactgtggctgcaccatctgtcttcatcttcccgccatctagctacgt

SEQ ID NO: 588056 - DNA, 510 bp, Homo sapiens; identical to SEQ ID NO: 566324
  misc_feature: HIJSMM301D4072.5.60.F05.1.454.light.4.raw

SEQ ID NO: 588057 - DNA, 494 bp, Homo sapiens; identical to SEQ ID NO: 535276
  misc_feature: HIJSMM301D9BE1.16.6.A06.1.454.light.4.raw

SEQ ID NO: 588058 - DNA, 517 bp, Homo sapiens
  misc_feature: HIJSMM301EMXAM.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtggcagtggatctgggacacaattcactctcaccatcgctgatctgcagcctgaagattttgcaacttactactgtcaacagagtttcagtgtcccccggacgtcggtccacgggaccgacgacgtagaaagtagagacgaaacgtagtaggcgtgcaccactactcgtcttctactcttcccgt

SEQ ID NO: 588059 - DNA, 492 bp, Homo sapiens; identical to SEQ ID NO: 547805
  misc_feature: HIJSMM301ADDLC.48.38.D05.1.454.light.4.raw

SEQ ID NO: 588060 - DNA, 483 bp, Homo sapiens; identical to SEQ ID NO: 575196
  misc_feature: HIJSMM301BLJ4J.41.34.D01.1.454.light.4.raw

SEQ ID NO: 588061 - DNA, 503 bp, Homo sapiens
  misc_feature: HIJSMM301A644L.12.82.H05.1.454.light.4.raw
atacgacgtacacgaccggtgctcgatttagtcgagctctctcgcggggagagctgctcagttaggacccagagggaaccatggaaaccccagcgcagcttctcttcctcctgctactctggctcccagagaccaccggagaaattgtgttgacgcagtctccaggcaccctgtctttatctccaggggaaagagccaccctctcctgcagggccagtgagaatgttaacaacaggtatctggcctggtaccagcagaaacctggccaggctcccaggctcctcatgtacgttacttccagcagggccactggcatcccagacaggttcactggcagtgggtctgggacagacttcactctcaccatcaccagactggagcctgaagattttgcagtgtattattgtcagcagtatggtagcgcaccgtactacttttggccgaggggtccaagctggagatgaaacgaactgtggctgcaccatctgtcttcatcttccccg

SEQ ID NO: 588062 - DNA, 420 bp, Homo sapiens; identical to SEQ ID NO: 541940
  misc_feature: HIJSMM301B1L3Z.9.34.D01.1.454.light.4.raw

SEQ ID NO: 588063 - DNA, 484 bp, Homo sapiens
  misc_feature: HIJSMM301BLJQN.46.26.C04.1.454.light.4.raw
actagcagtacacgaccggtgctcgatttagtctagcgactttgggtttggggtgatcaggactcctcagttcaccttctcacaatgaggctccctgctcagctcctgggactgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaaggtggagatcaaacgaa

SEQ ID NO: 588064 - DNA, 484 bp, Homo sapiens; identical to SEQ ID NO: 535240
  misc_feature: HIJSMM301EP5XY.47.60.F05.1.454.light.4.raw

SEQ ID NO: 588065 - DNA, 493 bp, Homo sapiens
  misc_feature: HIJSMM301AHGMD.10.77.G11.1.454.light.4.raw
catagtagtgcacgaccggtgctcgatttagctagtcactcaagggaaagggggaggaactgctcagttaggacccagagggaaccatggaagccccagctcagcttctcttcctcctgctactctggctcccagattccaccggagaagttgtgttgacacagtctccagccaccctgtctttgtctccaggggaaagagccaccctctcctgcagggccagtcagagtcttaggagctccttagcctggtatcaacagaaacctggccaggctcccaggctcctcatctatgatgcatccaacagggccactggcatcccagccaggttcagtggcagtgggtctgggacagacttcactctcaccatcagcagactagagcctgaagattttgcagtttattactgtcagcagcgtagcaactggcctcggacgttcggccgaagggaccgaaagtggacgatcaagcgaactgtggctgcaccatctgt

SEQ ID NO: 588066 - DNA, 463 bp, Homo sapiens; identical to SEQ ID NO: 535062
  misc_feature: HIJSMM301DEI8A.11.73.G07.1.454.light.4.raw

SEQ ID NO: 588067 - DNA, 486 bp, Homo sapiens; identical to SEQ ID NO: 563765
  misc_feature: HIJSMM301CF57C.22.59.F04.1.454.light.4.raw

SEQ ID NO: 588068 - DNA, 383 bp, Homo sapiens; identical to SEQ ID NO: 447524
  misc_feature: HIJSMM301C8KRD.41.26.C04.1.454.light.4.raw

SEQ ID NO: 588069 - DNA, 476 bp, Homo sapiens
  misc_feature: HIJSMM301DW963.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagtgtttgggtgttcggcgaggga

SEQ ID NO: 588070 - DNA, 457 bp, Homo sapiens; identical to SEQ ID NO: 536586
  misc_feature: HIJSMM301DP9LM.49.85.H08.1.454.light.4.raw

SEQ ID NO: 588071 - DNA, 487 bp, Homo sapiens
  misc_feature: HIJSMM301B86P6.48.5.A05.1.454.light.4.raw
agtatacatacacgaccggtgctcgatttagatagatagacagggggcaggagtcagacccagtcaggacacagcatggacatgagggtccccgctcagctcctggggctcctgctgctctggctcccaggtgccaaatgtgacatccagatgacccaggctccttccaccctgtctgcatctgtaggagacagagtcaccatcacttgccgggccagtcagagtattgttagctggttggcctggtatcaacagagaccagggaaagcccctaaactcctgatctatacggcatctactttacagagtggggtcccatcaaggttcagcggcagtgcatctgggacagaattcactctcaccatcagcagcctgcagcctgatgattttgcaacttattactgcaacagtattatacttatccatggacgttcggtccgaaggaccgaaggtaggaaagtacaaacgaaactagtggcgtgcacca

SEQ ID NO: 588072 - DNA, 447 bp, Homo sapiens; identical to SEQ ID NO: 535882
  misc_feature: HIJSMM301DBCL2.18.9.A09.1.454.light.4.raw
  modified_base (429)..(429): a, c, t, g, unknown or other

SEQ ID NO: 588073 - DNA, 517 bp, Homo sapiens
  misc_feature: HIJSMM301DN174.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttacccctcaccatcaggggtctacagcctgaagattttgcgacttactattgtcaacagagttaccttctcccccggacgttcgtccgacggaccgaacggtacggaaagtacaagacgaacgtacgtggcgtgcgaccactctgtcttctatcttcccgt

SEQ ID NO: 588074 - DNA, 461 bp, Homo sapiens
  misc_feature: HIJSMM301CDEVB.51.1.A01.1.454.light.4.raw
cgatcgtatacacgaccggtgctcgatttagacgtctcatcagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggaaagcccctaagctcctgatcctcgatgcatccaatttggaaacaggggtcccatcaaggttcagtgcaagtggctctgggacagatttcactttcaccatcagcagactgcagcctgaagatattgcaacatattactgtcaacagtatgataatctcccgctcactttcggcggagggaccaaggtggggatcaacgaa

SEQ ID NO: 588075 - DNA, 493 bp, Homo sapiens
  misc_feature: HIJSMM301DBTXO.18.59.F04.1.454.light.4.raw
tacgagtatgcacgaccggtgctcgatttagtacacacacttagggagttgggggctggagtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcagggtttctaatcgcttctctggctccaagtctggcaacacggcctcctgaccatctctgggctccaggctgaggacgaggctgattattactgcagctcatatacaagcaccagcactctctatgtcttcggaactgggaccaaggtcaccgtctaggtcagcccaa

SEQ ID NO: 588076 - DNA, 484 bp, Homo sapiens
  misc_feature: HIJSMM301C2UME.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcaggcacagattttacactgaaaatcagcagagtggaggctgaggatgttgggctctattattgcatgcaagctctacaagtcccgctcactttcggcggagggaccaggtggagatacaaacgaa

SEQ ID NO: 588077 - DNA, 502 bp, Homo sapiens
  misc_feature: HIJSMM301D37CR.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagccccaaggccaacccccactgtcactctgttcccgccctcctccaccgagagta

SEQ ID NO: 588078 - DNA, 486 bp, Homo sapiens
  misc_feature: HIJSMM301B9I68.4.51.E07.1.454.light.4.raw
agcactgtagcacgaccggtgctcgatttagcatactctacaacacacaaagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttaggagcaacttagcctggtaccagcataaacctggccaggctcccaggctcctcatctatggtgcatccaccagggccactggtatcccagccacgttcagtggcagtgggtctgggacacagttcactctcaccatcagcagcctgcagtctgaagattttggagtttattactgtcagcagtataataactggcctctcactttcggcggagggaccaaggtggagatcaaacgaactgtggctgcacc

SEQ ID NO: 588079 - DNA, 496 bp, Homo sapiens; identical to SEQ ID NO: 536802
  misc_feature: HIJSMM301DLD04.5.24.C02.1.454.light.4.raw

SEQ ID NO: 588080 - DNA, 508 bp, Homo sapiens
  misc_feature: HIJSMM301D8Z0X.47.85.H08.1.454.light.4.raw
agctcacgtacacgaccggtgctcgatttagtatcactcagtcgcgggggctggggtctcaggaggcagcgctctcaggacatctccaccatggcctgggctctgctgctcctcaccctcctcactcagggcacagggtcctgggcccagtctgccccgactcagcctgcctccgtgtctgggtctcctggacagtcgatcaccatctcctgcactggaaccagtagtgacgttggcagttctgattctatctcctggtaccaacaacacccaggccaaagcccccaaactcataatttatgacgtcaatgttcgcccctcagggtttctcatcgcttctctggctccaaatctggcaacacggcctccctgaccatctctgggctcgagtctgaggacgaggctgattacttctgttgctcttgggcaactactgtcgtttgggtgttcggcggagggaccaagttgaccgtcctaggtcagcccaaggctgccccctcggtcactc

SEQ ID NO: 588081 - DNA, 494 bp, Homo sapiens; identical to SEQ ID NO: 535276
  misc_feature: HIJSMM301EK7DS.16.6.A06.1.454.light.4.raw

SEQ ID NO: 588082 - DNA, 501 bp, Homo sapiens
  misc_feature: HIJSMM301CXU13.13.76.G10.1.454.light.4.raw
tcacgtactacacgaccggtgctcgatttagtcactcatacaggggggaagcctgggaacacttagccttcatgagtgtccccaccatggcctggatgatgcttctcctcggactccttgcttatggatcaggagtggattctcagactgtggtgacccaggagccatcgttctcagtgtctcctggagggacagtcacactcacttgtggcttgagatacggctcagtctctagtagttactaccccagctggtaccaacagaccccaggccaggctccgcgcacgctcatctacaacacaaacactcgctcttctggggtccctcatcgcttctctggctccatccttgggaacaaagctgcccttatcatcacgggggcccaggcagaagatgaatctgattattactgtgttctttatatgggtagtgccatttctgctgtgttcggaggaggcacccggctgaccgtcctcggtcagcccaaggctgcccccatcc

SEQ ID NO: 588083 - DNA, 514 bp, Homo sapiens; identical to SEQ ID NO: 546238
  misc_feature: HIJSMM301DUK13.47.85.H08.1.454.light.4.raw

SEQ ID NO: 588084 - DNA, 416 bp, Homo sapiens; identical to SEQ ID NO: 536892
  misc_feature: HIJSMM301EXGYL.16.46.E02.1.454.light.4.raw

SEQ ID NO: 588085 - DNA, 485 bp, Homo sapiens; identical to SEQ ID NO: 535880
  misc_feature: HIJSMM301DP92M.7.75.G09.1.454.light.4.raw

SEQ ID NO: 588086 - DNA, 447 bp, Homo sapiens; identical to SEQ ID NO: 535020
  misc_feature: HIJSMM301EYYQM.18.9.A09.1.454.light.4.raw

SEQ ID NO: 588087 - DNA, 517 bp, Homo sapiens; identical to SEQ ID NO: 537838
  misc_feature: HIJSMM301CHCLR.7.86.H09.1.454.light.4.raw

SEQ ID NO: 588088 - DNA, 501 bp, Homo sapiens; identical to SEQ ID NO: 535746
  misc_feature: HIJSMM301ET0UB.18.11.A11.1.454.light.4.raw

SEQ ID NO: 588089 - DNA, 498 bp, Homo sapiens
  misc_feature: HIJSMM301BNINM.43.34.D01.1.454.light.4.raw
tgtgagtagtcacgaccggtgctcgatttagatcgtctgtgttggggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctcctgacaatctctgggctccaggctgaggacgaggctgattattattgctgctcatatgcaggtagttacacttatgtcttcggaattgggacgacggtcaccgtcctaggtcagcccaaggccaaccc

SEQ ID NO: 588090 - DNA, 523 bp, Homo sapiens
  misc_feature: HIJSMM301CROW6.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctcctgaccatctccgggctccagcctgaggacgaggctgattattattgtagttcatatacaaccagtgacacttgggtgttcggcgggagggaccaggctgaccgtcctaggtcagcccaaggctcgccccctcggtcactctcgttcccaccct

SEQ ID NO: 588091 - DNA, 508 bp, Homo sapiens
  misc_feature: HIJSMM301EUBCO.19.59.F04.1.454.light.4.raw
tactctcgtgcacgaccggtgctcgatttagtacacacacttagggattgggggcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtcaccatctcctgctctggaagcagctccaacattgggaagaattttgtgtcctggtaccagcagctcccaggaacagcccccaaactcctcatttttgacaataataagcgaccctcagggattcctgaccgattctctggctccaagtctggcacgtcagccaccctgggcatcaccggactccagactggggacgaggccgattattactgcggaacatggatagcagcctgagtactgtgataatcggcggagggaccaagctgaccgtcctaggtcagcccaaggctgccccctcggtcactctgttcca

SEQ ID NO: 588092 - DNA, 478 bp, Homo sapiens
  misc_feature: HIJSMM301C885J.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagccctccctggccatcactgggctccaggctgaggatgaggctgattatactgccagtcgtatgacagcagcctgagtgtttgggtgttcgggcggaggga

SEQ ID NO: 588093 - DNA, 496 bp, Homo sapiens
  misc_feature: HIJSMM301BEMGJ.40.54.E10.1.454.light.4.raw
tctagcgactcacgaccggtgctcgatttagatcgtagcagaacacacaaagggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccagcatcacctgctctggagattcattgtcaaagcaatatgcttattggtaccagcagaaaccaggccaggcccctgtggtggtgctatataaagacactgagaggccctcagggacccctgagcgattctctggctccaggtcagggacaacagtcacgttgaccatcagtggagtccaggcagaagacgaggctgactattactgtcaatcagcagacagcagtggtacttttcgggttttcggcggagggaccaagctgaccgtcctaggtcagcccaaggctgccccctggt

SEQ ID NO: 588094 - DNA, 500 bp, Homo sapiens; identical to SEQ ID NO: 540012
  misc_feature: HIJSMM301C85YB.52.34.D01.1.454.light.4.raw

SEQ ID NO: 588095 - DNA, 498 bp, Homo sapiens; identical to SEQ ID NO: 586194
  misc_feature: HIJSMM301EJXOR.10.37.D04.1.454.light.4.raw

SEQ ID NO: 588096 - DNA, 441 bp, Homo sapiens; identical to SEQ ID NO: 534971
  misc_feature: HIJSMM301CGDS8.11.3.A03.1.454.light.4.raw

SEQ ID NO: 588097 - DNA, 486 bp, Homo sapiens; identical to SEQ ID NO: 535043
  misc_feature: HIJSMM301CYO89.46.35.D02.1.454.light.4.raw

SEQ ID NO: 588098 - DNA, 493 bp, Homo sapiens; identical to SEQ ID NO: 537473
  misc_feature: HIJSMM301C6NJW.16.6.A06.1.454.light.4.raw

SEQ ID NO: 588099 - DNA, 494 bp, Homo sapiens
  misc_feature: HIJSMM301D40GA.41.38.D05.1.454.light.4.raw
tctatactatcacgaccggtgctcgatttagtatctgatagttgggtttgggggagccagacccagtcaggacacagcatggacatgagggtccccgctcagctcctggggctcctgctgctctggttcccaggttccagatgcgacatccagatgacccagtctccatcttctgtgtctgcatctgtcggagacagagtcaccatcacttgtcgggcgagtcagggtattggcagctacttagtctggtatcaacaaaaaccagggaaagcccctaaactccttatttatggatcatccagtttacaaagtggggtcccatcaaggttcagcggcagtggatctgggacacatttcactctcactatcagcagcctgcagcctgaggattttgcgacttactattgtcaacaggctgacagtttccctctcactttcggcggagggaccaaggttgagaccaaacgaactgtggctgcacatctgtcttcatt

SEQ ID NO: 588100 - DNA, 447 bp, Homo sapiens
  misc_feature: HIJSMM301CYI91.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgttcccgccttcctccatactcgta

SEQ ID NO: 588101 - DNA, 495 bp, Homo sapiens; identical to SEQ ID NO: 538269
  misc_feature: HIJSMM301DTNHF.9.1.A01.1.454.light.4.raw

SEQ ID NO: 588102 - DNA, 444 bp, Homo sapiens; identical to SEQ ID NO: 535594
  misc_feature: HIJSMM301CCRHN.9.9.A09.1.454.light.4.raw

SEQ ID NO: 588103 - DNA, 464 bp, Homo sapiens
  misc_feature: HIJSMM301D578O.26.78.H01.1.454.light.4.raw
agactatactcacgaccggtgctcgatttagtgtgagtagtttgggtttgggggaggaactgctcagttaggacccagagggaaccatggaagccccagctcagcttctcttcctcctgctactctggctcccaggggaaagagccaccctctcctgcagggccagtcagagtgttggcagctacttagcctggtaccaacagaaacctggccaggctcccaggctcctcatctatgatgcatccaacagggccactggcatcccagccaggttcagtggcagtgagtctgggacagacttcactctcaccatcagcagcctagagcctgaagattttgcactttattactgtcagcagcgtagcaactggcctctcactttcggcggagggaccagggtggagattagacgaactgtggctgcaccatctgtcttcatcttcccgccatctgaagtatagtct

SEQ ID NO: 588104 - DNA, 504 bp, Homo sapiens; identical to SEQ ID NO: 538940
  misc_feature: HIJSMM301BPL5T.2.35.D02.1.454.light.4.raw

SEQ ID NO: 588105 - DNA, 489 bp, Homo sapiens; identical to SEQ ID NO: 535139
  misc_feature: HIJSMM301AT2YS.14.55.E11.1.454.light.4.raw

SEQ ID NO: 588106 - DNA, 502 bp, Homo sapiens
  misc_feature: HIJSMM301A0PR0.48.80.H03.1.454.light.4.raw
agtatacatacacgaccggtgctcgatttagctgtgcgtcgaagggaaaggggggggaggaactgctcagttaggacccagacggaaccatggaagccccagcgcagcttctcttcctcctgctactctggctcccagatgtcactggagaaaaataatgacgcagtctccagcccccctgcctgtgtctccaggggaaagagccaccctctcctgcagggccagtcagagtattagcagtgacttaaccttctacaaccagagacctggccaggctcccaggctcctggccaggtttccaggctcctcatccatggtgcatccaccagggccactggtatctcagccaggttcagtgccagtgggcctgggacagagttcactctcaccatcaccagcctgcagtctgaagattttgcattttattactgtcagcactataataactggccacgtggacgttcggccaagggaccaaggaactgtggctgcaccatctgtt

SEQ ID NO: 588107 - DNA, 520 bp, Homo sapiens
  misc_feature: HIJSMM301E4D4L.14.70.G04.1.454.light.4.raw
cgtctagtaccacgaccggtgctcgatttagtgtagtgtgaagggaaaggggagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccaggggcaccgtcctccagggagcccatgctgcaagtcgggccagaggtgcccctgaacctgaaggccaatgagacccaagacaggccaagtgggttgtgagacccctgaggagctgggccctggtcccaggcagcgctggcccctgctgctgctgggtctggccatggtcgcccatggcctgctgcgcccaatggttgcaccgcaaagcggggacccagaccctggagcctcagttggaagcagccgatccagcctgcggagcctgtggggcaggtcagcccaaggccaaccccactgtcactctccg

SEQ ID NO: 588108 - DNA, 515 bp, Homo sapiens
  misc_feature: HIJSMM301A2KZO.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaaccggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtctaagtcagcccaaggctgccccctcggtcactctgttcccaccctcctcg

SEQ ID NO: 588109 - DNA, 489 bp, Homo sapiens; identical to SEQ ID NO: 536013
  misc_feature: HIJSMM301EYGYU.26.23.C01.1.454.light.4.raw

SEQ ID NO: 588110 - DNA, 487 bp, Homo sapiens
  misc_feature: HIJSMM301BW3YV.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaacacagcctccctgaccattactggactccagcctgaggacgaggctgactattactgctcagcatgggacagcggcctcaggacttatgtcttcggaactgggacccacgttaccgtcctaggtcagaccccg

SEQ ID NO: 588111 - DNA, 491 bp, Homo sapiens
  misc_feature: HIJSMM301EPH8H.3.33.C11.1.454.light.4.raw
agacgcactccacgaccggtgctcgatttagagtgagctcgttgggtttgggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacattggtgattataactatgtctcctggtaccagcagcacccaggcaaagcccccaaactcatgatttatgaggtcacaaagcggccctcaggggtccctgatcgcttctctgcctccaagtctggcaacacggcctccctgaccgtctctgggctccagcctgaggatgaggctgattattactgcagctcatatgcaggcatcaacactgttttcggcggagggaccaagctgaccgtcctaggtcagcccaaggcctg

SEQ ID NO: 588112 - DNA, 512 bp, Homo sapiens; identical to SEQ ID NO: 557424
  misc_feature: HIJSMM301CGWYZ.16.46.E02.1.454.light.4.raw

SEQ ID NO: 588113 - DNA, 494 bp, Homo sapiens
  misc_feature: HIJSMM301A0I0D.12.33.C11.1.454.light.4.raw
atacgacgtacacgaccggtgctcgatttagagtgagctcgttgggtttgggggcaggagtcagtctcagtcaggacacagcatggacatgagggtccccgctcagctcctggggctcctgctactctggctccgaggtgccagatgtgacatccagatgacccagtctccttcctccctgtctgcatctgtcggagacagcgtcaccatcacttgtcgggcaagtcagaacatttacaattatttaaattggtatcagcagaaaccagggaaagcccctaaactcctgatctatcatgaatccagtttgcgaagtggagtcccatcaaggttcagtggcactgggtctgagacagagttcactctcaccatcagcactctacagcctgaagattttgcaacttattattgtcaacaaagttatgagacccctgccactttcggtccctcgggaccgatagtggatatgaaacgaaactagtggctgcaccact

SEQ ID NO: 588114 - DNA, 499 bp, Homo sapiens
  misc_feature: HIJSMM301DBII8.19.78.H01.1.454.light.4.raw
tactctcgtgcacgaccggtgctcgatttagtgtgagtagtttgggtttgggggctttatttgggctctgctgctcctcactctactcactcaggacacagggtcctgggcccagtctgccctgactcagtctgcctcggtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcactctgttcccaccctcctccacgagagta

SEQ ID NO: 588115 - DNA, 521 bp, Homo sapiens; identical to SEQ ID NO: 539470
  misc_feature: HIJSMM301AL96P.27.23.C01.1.454.light.4.raw

SEQ ID NO: 588116 - DNA, 490 bp, Homo sapiens
  misc_feature: HIJSMM301C2W27.12.51.E07.1.454.light.4.raw
atacgacgtacacgaccggtgctcgatttagcatactctacaacacacaaagggggcaggagtcagacccagtcaggacacagcatggacatgagggtccccgctcagctcctggggctcctgctgctctggctcccaggtgccgcatgcgacatcctgatgacccagtctccctccaccctgtctgcagcagtcggagacagagtcaccatcacctgccgggccagtcagaatcttgggaggtggttggcctggtatcagcagaaaccaggggacagcccctaaactcctgatttttaagacatctgatttagaaagtggggtcccatcaaggttcagcggcagtgggtctgggacagaattcactctcaccatcagcagcctgcaacctgatgactttgcaacttattactgccaacagtataatggttatgaatccacttttggccaagggaccaagctggagatcaaacgaactgtggctgcacca

SEQ ID NO: 588117 - DNA, 500 bp, Homo sapiens
  misc_feature: HIJSMM301ATS9I.40.8.A08.1.454.light.4.raw
tctagcgactcacgaccggtgctcgatttagcatactctacagggggctacaacaggcaggcaggggcagcaagatggtgttgcagacccaggtcttcatttctctgttgctctggatctctggtgccaacggggacatcgtgatgacccagtctccagactccctggctgtgtctctgggcgagagggccaccatcaactgcaagtccagccagactgttttatacagctccaacaatgagaactacgttgcttggtaccagcagaaaccaggacagcctcctaagttgctcatttactgggcatctacccgggcatccggggtccctgaccgattcagtggcagcgggtctgggacagatttcactctcaccatcaacaacctgcaggctgaagatgtggcagtttattactgtcaacaatattattatactccgccgacgttcggccggggaccgaacgtggaaatcaaacgaactagtggctgcaccatctgtctt

SEQ ID NO: 588118 - DNA, 469 bp, Homo sapiens
  misc_feature: HIJSMM301BAAX5.10.20.B09.1.454.light.4.raw
catagtagtgcacgaccggtgctcgatttagtgtagtgtgaagggggaggaactgctcagttaggacccagacggaaccatggaagccccagcgcagcttctcttcctcctgctactctggctcccagacaacactgcagaaatagttatgacgcagtctccagccaccctgtctgtgtctccaggggagagagccaccctctcctgcagggccggtcagaatattgctaccaacttagcctggtatcaacaaaagcctggccaggctcccagactcctcatctctggtgcatcttcgagggccactggtgtcccagccaggttcagtggcagtgggtctggaacagagttcactctcaccatcagcggcctgcagtctgaagattttgcagtttattactgtcagcagtataatgacttgggttttattctactttcggccctgggaccaaagtggatttcagacgaa

SEQ ID NO: 588119 - DNA, 497 bp, Homo sapiens; identical to SEQ ID NO: 568860
  misc_feature: HIJSMM301DG47M.18.59.F04.1.454.light.4.raw

SEQ ID NO: 588120 - DNA, 497 bp, Homo sapiens
  misc_feature: HIJSMM301AQLPK.10.79.H02.1.454.light.4.raw
catagtagtgcacgaccggtgctcgatttagtgtcacacgaaggggaaagggggaagagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccacgctctcctgcagggccagtcagagtcttagcagcaactacgttgcctggtaccaacagaaacctggccaggctcccgggctcctcatctatggtacatctagcagggccactggcatcccagacaggttcagtggcagtgggtctgggacagacttcactctcaccatcagcagactggagtctgaagattttgcagtgtattattgtcagcaatatggtaggtcacctgggacttttggccaggggaccaagctggagatcaaacgaactagtggctgcaccatctgtctt

SEQ ID NO: 588121 - DNA, 512 bp, Homo sapiens
  misc_feature: HIJSMM301D94NH.17.28.C06.1.454.light.4.raw
cgtagactagcacgaccggtgctcgatttagagctcacgtattgggtttggggagagaagacaggattcaggacaatctccagcatggccggcttccctctcctcctcaccctcctcactcactgtgcagggtcctgggcccagtctgtgctgactcagccaccctcagtgtctgggaccccgggcagagggtcaccatatcttgttctggaaacagctccggcatctcaactaaacatttttgctggtaccagcaattcccaggatcggccccccgatcctcatctatagaaatgatcatcggccctccggggtccctgaccgattctctggctccatgtctggcacctcagcctccctgaccatcagtgggcctccggtccgaggatgaggctgattattactgtgcaccgtgggatgacatcctgaatggtccggtgttcggcggaggaccaggctgaccgtctaagtcagcccaaggctcgccccctggtcactctgttcccaccctt

SEQ ID NO: 588122 - DNA, 480 bp, Homo sapiens
  misc_feature: HIJSMM301BFHLH.13.76.G10.1.454.light.4.raw
tcacgtactacacgaccggtgctcgatttagtcactcatacaggggctgggcctcaggaagcagcatcggaggtgcctcagccatggcatggatccctctcttcctcggcgtccttgcttactgcacaggatccgtggcctcctatgagctgactcagccaccctcagtgtccgtgtccccaggacagacagccagcatcacctgctctggaaataaattggcagataaatatacttcctggtatcagcagaagtcaggccagtcccctgtgctggtcatctatcaagatgccaagcggccctcagggatccctgagcgattctctggctccaactctgggaacacagccactctgaccatcagcgggacccaggctgtggatgaggctgactattactgtcaggcgtgggacagcagcactgcctccttcggaactgggaccaaggtcaaccgtcctaggtcagcccaaggccaacccc

SEQ ID NO: 588123 - DNA, 501 bp, Homo sapiens
  misc_feature: HIJSMM301B6U9J.11.10.A10.1.454.light.4.raw
cgagagataccacgaccggtgctcgatttagcgtcgatctcagggggaactgctcagttaggacccagacggaaccatggaagccccagcgcagcttctcttcctcctgctactctggctcccagatagcactggagaaatagtgatgacgcagtctccagccaccctgtctgtgtctccaggggaaagagccaccctctcctgcagggccagtcagagtgttaggagcaacttagcctggtaccagcagaaacctggccaggctcccaggctcctcatctatggtgcatccaccagggccactggtttcccagtcaggttcagtggcagtgggtctgagacagagttcactctcaccatcaacggcctgcagtctgaagattttgctagtttattactgtcagcagtataataactggcctcggacgttcggccgaaggaccgaaggtaggaagtacgaacgaaactgtggctgcaccatctgtcttctactcttcccgt

SEQ ID NO: 588124 - DNA, 498 bp, Homo sapiens
  misc_feature: HIJSMM301CBS69.53.10.A10.1.454.light.4.raw
  modified_base (494)..(494): a, c, t, g, unknown or other
cgcgtatacacacgaccggtgctcgatttagcgtcgatctcaggggggcctcaggaagcagcatcggaggtgcctcagccatggcatggatccctctcttcctcggcgtccttgcttactgcacaggatccgtggcctcctatgagttgactcagccaccctcactgtccgtgtccccaggacagacagccaccatcacttgttctggagataaactggagaccaagtatatttgttggtatcaacagaggccaggcctgtcccctctgttggtcatgtatcaagataacaagcggccctctggcatccctgggcgattctctggctccaactctgggaacacagccactctgacccatcagcgggacccagactatggatgaggctgactattactgtcaggcatgggacagcgaaattgcggtgttcggcgggggaccgaaactgaccgtcctaggtcagcccaaggctgcccctcggtcactctgttcccnccct

SEQ ID NO: 588125 - DNA, 483 bp, Homo sapiens; identical to SEQ ID NO: 535317
  misc_feature: HIJSMM301A2VVY.4.1.A01.1.454.light.4.raw

SEQ ID NO: 588126 - DNA, 512 bp, Homo sapiens
  misc_feature: HIJSMM301APTU8.48.57.F02.1.454.light.4.raw
agtatacatacacgaccggtgctcgatttagctcgatatagttgggtttgggggctgtgggctcaggaggcagagctctgggaatctcaccatggcctggacccctctcctgctccccctcctcactttctgcacagtctctgaggcctcctctgagctgacacagccaccctcggtgtcagtgtccccaggacaaacggccaggatcacctgctctggagatgcattgccaagaaaattttgttattggtaccaactgaagtcaggccaggcccctgtcctggtcatttatgaggacgaccagcgaccctccaggatccctgcgaggttctctggatcgaactcagggacattggccaccttgactatcactggggcccaggtggaggatgaaggtgactacttctgtttctcaacagacaccagtgacaatcatgcgattttcggcggagggaccaagctgaccgtcctgggtcagcccaaggctgccccctcggtcactctgttccccg

SEQ ID NO: 588127 - DNA, 484 bp, Homo sapiens; identical to SEQ ID NO: 553263
  misc_feature: HIJSMM301CS9LK.46.26.C04.1.454.light.4.raw
  modified_base (445)..(445): a, c, t, g, unknown or other

SEQ ID NO: 588128 - DNA, 481 bp, Homo sapiens
  misc_feature: HIJSMM301DX026.4.34.D01.1.454.light.4.raw
agcactgtagcacgaccggtgctcgatttagatcgtctgtgttgggtttgggggaggaactgctcagttaggacccagacggaaccatggaagccccagcgcagcttctcttcctcctgctactctggctcccagaaaccactggagaaatagtgatgacgcagtctccaggcaccctgtctgtgtctccaggggacagagccaccctctcctgcagggccagtcagagtgttagcagcaacttagcctggtacctgcagaaacctggccaggctcccagctcctcatctatggtgcatccaccagggccactggtatcccagccaggttcagtgccagtgggtctgggacagagttcactctcaccatcagcagcctgcagtctgaagattttgcggtttattactgtcagcagtatgataactggctgtacacttttggccaggggaccaagctggagatcaggcgaactgtggctgca

SEQ ID NO: 588129 - DNA, 489 bp, Homo sapiens
  misc_feature: HIJSMM301B4U42.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctggaacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 588130 - DNA, 416 bp, Homo sapiens; identical to SEQ ID NO: 536892
  misc_feature: HIJSMM301A8KQJ.16.46.E02.1.454.light.4.raw

SEQ ID NO: 588131 - DNA, 497 bp, Homo sapiens; identical to SEQ ID NO: 536371
  misc_feature: HIJSMM301EM3VB.16.78.H01.1.454.light.4.raw

SEQ ID NO: 588132 - DNA, 501 bp, Homo sapiens; identical to SEQ ID NO: 536142
  misc_feature: HIJSMM301BPURG.15.1.A01.1.454.light.4.raw

SEQ ID NO: 588133 - DNA, 348 bp, Homo sapiens
  misc_feature: HIJSMM301C2MY2.19.86.H09.1.454.light.4.raw
tactctcgtgcacgaccggtgctcgatttagtgctatagacttgggtttgggagcagtggtgtgatgtggtatcagaaagtcccaggaacggccccaaactcgtcatctataatgacgctgagcggtccttaagggtccctgaccgattctctggcgagaggtctggcgcctcagcttccctggccatcagagggctccagtctgaagatgaggctgattattactgtgcaatctgggatgacagtgtgaacggtccggttttcggcggagggaccaagctgaccgtcctaagtcagcccaaggctgccccctcggtcactctgttcccaccctcctccacgagagta

SEQ ID NO: 588134 - DNA, 521 bp, Homo sapiens; identical to SEQ ID NO: 580934
  misc_feature: HIJSMM301BLSQ8.41.19.B08.1.454.light.4.raw

SEQ ID NO: 588135 - DNA, 505 bp, Homo sapiens
  misc_feature: HIJSMM301BSNSQ.22.21.B10.1.454.light.4.raw
acatacgcgtcacgaccggtgctcgatttagtgtcgtcgcaaggggggggtctcaggaggcagcgctctcaggacgtcaccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacgttggtggttacaagtatgtctcctggtaccaacaacacccaggcacagcccccaaactcatgatttatgaggtcactaagcgggcctcaggggtccctgatcgcttctctggctccaagtctggcgacacggcctccctgaccgtctctgggctccaggctgaggatgaggctgattattactgctactcatatgcaggcggcaactcttgggtgttcggcggagggaccaagctgaccgtcctaggtcagcccaaggctgccccctcggtcactctcg

SEQ ID NO: 588136 - DNA, 500 bp, Homo sapiens
  misc_feature: HIJSMM301CC92E.12.48.E04.1.454.light.4.raw
atacgacgtacacgaccggtgctcgatttagagagcgtcacagagagaaggggagcttcagctgtgggtagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccggagtgttcggcggagggaccagctgaccgtcctaggtcagcccaa

SEQ ID NO: 588137 - DNA, 479 bp, Homo sapiens
  misc_feature: HIJSMM301DXS4K.16.86.H09.1.454.light.4.raw
tgtactactccacgaccggtgctcgatttagtgctatagacttgggtttggggggggtctcaggaggcagcgctctcaggacatctccaccatggcctgggctctgctgctcctcaccctcctcactcagggcacagggtcctgggtcctccactggaaccagcagtgacgttggtggttataactttgtctcctgataccaacagcacccaggcaaagcacccaaattcatgatttatgaggtcactaatcggccctcaggggtttctaatcgcttctctggctccaagtctggcaacacggcctccctgaccatctctgggctccaggctgaggacgaggctgattattattgcatctcatatacaaccaacagcactctcgactggtattcggcggagggaccaagctgaccgtcctaggtcagcccaaggctgcccccctcggtcactctgttcccgccctcctcgagtagtaca

SEQ ID NO: 588138 - DNA, 493 bp, Homo sapiens; identical to SEQ ID NO: 537281
  misc_feature: HIJSMM301CJCU8.9.1.A01.1.454.light.4.raw

SEQ ID NO: 588139 - DNA, 471 bp, Homo sapiens
  misc_feature: HIJSMM301DCEKI.12.1.A01.1.454.light.4.raw
atacgacgtacacgaccggtgctcgatttagacgtctcatcagggggcaggagtcagtctcagtcaggacacagcatggacatgagggtccccgctcagctcctggggctcctgctactctggctccgaggtgccagatgtgacatccagatgacccagtctccatcctccctgtctgcatctgtagcagacagagtcaccatcacttgccgggcaagtcagaccatcagcagctatttaaattggtatcagcagaaaccagggaaagcccctaaggtcctgatctatgctgcatccagtttgcaaagtgggtcccatcaaggttcagtggcagtgggtctgggacagatttcactctcaccatcagcagtctgcaacctgaagattctgcaacttattactgtcaaacagagtaacagttaccctcccactttcggcggagggaccaaggtggagatcaaacgaactgtg

SEQ ID NO: 588140 - DNA, 485 bp, Homo sapiens
  misc_feature: HIJSMM301CZ74I.46.35.D02.1.454.light.4.raw
actagcagtacacgaccggtgctcgatttagcacacgatagttgggtttgggggagctgctcagttaggacccagagggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagcacaaacctggccaggctcccaggctcctcatctatgctgcatccatcagggccactggcatcccaggcagattcagtggcagtgggtctgggacagacttcactctcaccatcagcagactggagcctgaagattttgcagtctattactgtcagcagtatggtcacgtcccagaacttttggccaggggaccaagctggagatcaaacgaactgtggctgcaccat

SEQ ID NO: 588141 - DNA, 493 bp, Homo sapiens
  misc_feature: HIJSMM301AKTXJ.52.82.H05.1.454.light.4.raw
cgcagtacgacacgaccggtgctcgatttagtcgagctctctcgcgggggtgggtccaggaggcagaactctgggtgtctcaccatggcctggatccctctacttctccccctcctcactctctgcacaggctctgaggcctcctatgagctgacacagccaccctcggtgtcagtgtccccaggacagacggccaggatcacctgctctggagatattctgtcaaaccgttatgcttattggtaccagcagaagccaggccaggcccctgtgttggtgatatataaggacactgagaggccctcagggatccctgagcgattctctggctccacctcagggacactagtcacgttgaccatcagtggagtccaggcagaggacgaggctgactaccactgtcaatcaacagacagcagtggttcttatgtcttcgcaactgggaccaaggtcaccgtcctaggtcagcccaaggccaaccccactgtcactc

SEQ ID NO: 588142 - DNA, 515 bp, Homo sapiens
  misc_feature: HIJSMM301DJVVQ.15.34.D01.1.454.light.4.raw
tctacgtagccacgaccggtgctcgatttagatcgtctgtgttgggtttggggggaagcctgagaacacttagccttcatgagtgtccccaccatggcctggatgatgcttctcctcggactccttgcttatggatcaggagtggattctcagactgtggtgacccaggagccatcgttctcagtgtcccctggagggacagtcacactcacttgtgccttgaggtctggctcagtctctacttctaactacgccgcctggtaccggcagaccccaggccagcctccacgcacgctcatctacagtacaaacactcgctcttccggggtccctgatcgcttctctggctccatccttgggaacaaagctgccctcaccatcacgggggcccaggcagacgatgaatgtgattatcactgcgtcctttatgtggggcgttggcatttgggtgttcggcggagggaccaaactgaccgtcctaggtcagcccaaggctgccccctcggtcactctcg

SEQ ID NO: 588143 - DNA, 512 bp, Homo sapiens
  misc_feature: HIJSMM301EHY4J.5.24.C02.1.454.light.4.raw
atcagacacgcacgaccggtgctcgatttagtacagatcgttagggaaagggggggtctcaggaggcagcgctctcaggacgtcaccaccatggcctgggctctgctcctcctcaccctcctcactcagggcacagggtcctgggcccaggctgccctgactcagcctccctccgcgtccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagccagtccccactgtgatcttcggcggggggaccgaagctgaccgtcctaggtcagcccaacggctcgtccccccg

SEQ ID NO: 588144 - DNA, 498 bp, Homo sapiens
  misc_feature: HIJSMM301EEE4A.9.12.B01.1.454.light.4.raw
tgatacgtctcacgaccggtgctcgatttagtagtgtagattccgcggggattgtgaagtgagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgtttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagttttctcgggcgttcggccaagggaaccaaggtggaaatcaaacgaactgtggctgcacta

SEQ ID NO: 588145 - DNA, 524 bp, Homo sapiens
  misc_feature: HIJSMM301C8ZHZ.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccgaaactcattctttatgatgtcagtaatcggccccaggggtttctgatcgcttctatggctccaagtctgcctacacggcctccctgaccatctccgggctccagcctgaggacgaggctgattattattgtagttcatatacaaccagtgactacttgggtgttcggcggagggaccaggctgaccgtcctaggtcacgcccaaggctgccccctcggtcactctcgttcccaccct

SEQ ID NO: 588146 - DNA, 506 bp, Homo sapiens
  misc_feature: HIJSMM301ERLS1.15.56.F01.1.454.light.4.raw
tctacgtagccacgaccggtgctcgatttagcagacgtctgtcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggacttacaaccttgtctcctggtaccaacatcacccaggcaaagcccccaaactcatgatttatgaggacaatgagcggccctcaggggtttctaatcgcttctctggctccaagtctgacaacacggcctcccttgaccaatctctggctccaggctgaggacgagggtgattattactgctgcgcagtatagaagtcccactgttgtacttttcggcggagggaccaagctgaccgtcctaggtcagccctaaggctcgccccctcggtcactcgtcttcccgccctcctcgctacgtaga

SEQ ID NO: 588147 - DNA, 489 bp, Homo sapiens
  misc_feature: HIJSMM301DGJID.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacacgtacccccctcactttcggcggagggaccaaggcggagatcagacgaactgtggctgcacatctgtcttcta

SEQ ID NO: 588148 - DNA, 504 bp, Homo sapiens
  misc_feature: HIJSMM301BVXDE.12.48.E04.1.454.light.4.raw
atacgacgtacacgaccggtgctcgatttagagagcgtcacagagagaaggggagagaagacaggactcaggacaatctccagcatggccagcttccctctcctcctcaccctcctcactcactgtgcagggtcctgggcccagtctgtgctgactcagccaccctcagcgtctgggacccccgggcagagggtcaccatttcttgttctggaacccactccaacatcggatataattctgtagactggtaccagcagcttccaggagccggccccccgactcctcatctttaataacaatcagcggccctcaggggtccctgaccgattctctggctccaagtctggcacctcagcctccctggccatcagtgggctccagtctgaggatgaggctgattattactgtgcatcatgggctgacaccctgactggtccgggagtgttcggcggagggaccaagctgaccgtcctaggtcagcccaaggcagccccctggtcact

SEQ ID NO: 588149 - DNA, 518 bp, Homo sapiens; identical to SEQ ID NO: 554776
  misc_feature: HIJSMM301AM2ZC.43.81.H04.1.454.light.4.raw

SEQ ID NO: 588150 - DNA, 496 bp, Homo sapiens
  misc_feature: HIJSMM301A2UFT.3.1.A01.1.454.light.4.raw
agacgcactccacgaccggtgctcgatttagacgtctcatcaagggaaggaagggggaggaactgctcagttaggacccagagggaaccatggaagccccagctcagcttctcttcctcctgctactctggctcccagataccaccggagaaattgtgttgacacagtctccagccaccctgtctttgtctccaggggaaagagccaccctctcctgcagggccagtcagagtgttagcaactacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctctcactttcggcggagggaccaaggtggagatcaaacgaactgtggctgcaccatctgtctt

SEQ ID NO: 588151 - DNA, 442 bp, Homo sapiens
  misc_feature: HIJSMM301ANJE9.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcctccctggccagtcactgggctccagcctgaggatgaggctgattattactgtcagtcctttgacattaaactggatgtggtattcggcggagggacccacgtaaccgtcctaggtcagcccaaggctgccccctcggtcactctgttcccaccctcctcgtatctctcg

SEQ ID NO: 588152 - DNA, 434 bp, Homo sapiens; identical to SEQ ID NO: 535153
  misc_feature: HIJSMM301EF87V.18.5.A05.1.454.light.4.raw

SEQ ID NO: 588153 - DNA, 460 bp, Homo sapiens; identical to SEQ ID NO: 537107
  misc_feature: HIJSMM301BY331.22.28.C06.1.454.light.4.raw

SEQ ID NO: 588154 - DNA, 439 bp, Homo sapiens
  misc_feature: HIJSMM301DKQF4.41.9.A09.1.454.light.4.raw
tctatactatcacgaccggtgctcgatttagcgagacgcgcagggtcctgggcccagtctgtcctgactcagccaccctcagcgtctgggacccccgggcagacggtgaccatctcctgttctggaagcagttccaacatcggaagtaataatgtgaattggtaccggcaactcccaggaacggcccccaaactcctcatacatagtaatgatcatcggcccctggggtccctgaccgaatctctggctccaggtctggcgcctcagcctccctggtcattagtgggctccagtctgacgatgaggctgactattactgttcagcgtgggatgccagcccgaatcattgggtgttcggcggagggaccaaactgaccgtcctaggtcagcccaaggctgcccctcggtcactctgttcccgccctcctcatagtataga

SEQ ID NO: 588155 - DNA, 491 bp, Homo sapiens
  misc_feature: HIJSMM301EWK6H.4.33.C11.1.454.light.4.raw
agcactgtagcacgaccggtgctcgatttagagtgagctcgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttatatacagctccaacaatgagaactacttagcttggtatcagcagaaaccaggacagcctcctaagctgctcatttaccgggcagctacccgggaatccggggtccctgagcgattcagtggcagcgggtctgggacagatttcactctcaccatcagcagcctgcaggctgaagatgtggcagtttattactgtcagcaatattctactactcctcggactttcggcggagggaccgaacggtggagatcaaacgaacta

SEQ ID NO: 588156 - DNA, 447 bp, Homo sapiens; identical to SEQ ID NO: 535201
  misc_feature: HIJSMM301C18GJ.18.9.A09.1.454.light.4.raw

SEQ ID NO: 588157 - DNA, 447 bp, Homo sapiens; identical to SEQ ID NO: 553049
  misc_feature: HIJSMM301DY6OP.18.73.G07.1.454.light.4.raw

SEQ ID NO: 588158 - DNA, 509 bp, Homo sapiens
  misc_feature: HIJSMM301CF3OG.16.1.A01.1.454.light.4.raw
tgtactactccacgaccggtgctcgatttagacgtctcatcaggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcaccatctcctgcactggaaccaacattgacgttggtgattataactttgtctcctggtaccaacaacacccaggcaaagcccccaaactcatcatttatgaagtctctaagcggccctcaggggtatctaatcgcttctctggctccaagtctggcaacacggcctccctgaccgtctctggcctccagactgaggacgaggctgattattactgccactcatatagaagtagtactactcctgtggttttcggcggagagaccaagctgaccgtcctaggtcagcccaaggctgccccctcggtcactcttcg

SEQ ID NO: 588159 - DNA, 523 bp, Homo sapiens
  misc_feature: HIJSMM301EFY9C.52.62.F07.1.454.light.4.raw
cgcagtacgacacgaccggtgctcgatttagtagtcgcataaagggaaaggggctgggcctaaggaagcagcactggtggtgcctcagccatggcctggaccgttctcctcctcggcctcctctctcactgcacaggctctgtggcctcctctgtggtgacacagccaccctcggtgtctgtggccccgggaaagacggcctcaataacctgtgagagagacaacattgaaagaagacatgtacactggtaccagctgaggcccggccaggcccccagattggtcctctataatgatgacgaccggccctcagggatccctgagcgcttttctggctccaattctgggaacacggctaccctgaccatcactagggtcgaagccggggacgaggccgactattactgtcaggtgtgggatagtaatactgatcaatatgtcttcggaactgggaccacggtcaccgtcctaagtcagcccaaggccaacccactgtcactctgttcccaccctcctctatacg

SEQ ID NO: 588160 - DNA, 489 bp, Homo sapiens
  misc_feature: HIJSMM301BR55B.43.60.F05.1.454.light.4.raw
tgtgagtagtcacgaccggtgctcgatttagtacgtcatcagggaaagggggcaggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgcaacttattactgtctacaagattcttcttaccctcggacgttcggtccagggaccgacggtggatgttcaagcgaactgtggcgtgcaccta

SEQ ID NO: 588161 - DNA, 485 bp, Homo sapiens; identical to SEQ ID NO: 538533
  misc_feature: HIJSMM301CVJIU.47.78.H01.1.454.light.4.raw

SEQ ID NO: 588162 - DNA, 499 bp, Homo sapiens; identical to SEQ ID NO: 538774
  misc_feature: HIJSMM301AHDEI.26.26.C04.1.454.light.4.raw

SEQ ID NO: 588163 - DNA, 494 bp, Homo sapiens; identical to SEQ ID NO: 534994
  misc_feature: HIJSMM301CIRNP.27.78.H01.1.454.light.4.raw

SEQ ID NO: 588164 - DNA, 474 bp, Homo sapiens; identical to SEQ ID NO: 586533
  misc_feature: HIJSMM301B997I.7.81.H04.1.454.light.4.raw

SEQ ID NO: 588165 - DNA, 507 bp, Homo sapiens
  misc_feature: HIJSMM301AQPOS.7.71.G05.1.454.light.4.raw
cgtgtctctacacgaccggtgctcgatttagtgtcgtcgcaagagagaggggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagagtgttggcgcctacgtagcctggtaccaacagaaacctggccaggctcccaggcccctcatctatggtgcatccaacagggccactggcatcccagccaggttcagtggcagtgggtctgggacagacttcactctcaccatcatcagcctggagcctgaagatgttgcagtttattactgtcaacatcgtaccgagtggccgtccgggggccacttcggccctgggaccaaagtggatatcaaacgaactagtggctgcaccactctgtctt

SEQ ID NO: 588166 - DNA, 503 bp, Homo sapiens
  misc_feature: HIJSMM301AWQW2.4.39.D06.1.454.light.4.raw
agcactgtagcacgaccggtgctcgatttagtgacatctcgcagttctttggggggggtcgtcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggcgagggaccaaactgaccgtcctaaggtcagcccaaggctgccccctc

SEQ ID NO: 588167 - DNA, 499 bp, Homo sapiens
  misc_feature: HIJSMM301B1TP7.43.37.D04.1.454.light.4.raw
tgtgagtagtcacgaccggtgctcgatttagtagcatactgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacacggtcaccgtcctaggtcagcccaaggccaacccca

SEQ ID NO: 588168 - DNA, 504 bp, Homo sapiens
  misc_feature: HIJSMM301CLBN8.12.50.E06.1.454.light.4.raw
atacgacgtacacgaccggtgctcgatttagatctactgacaacacacaaggggggagaagagctgctcagttaggacccagagggaaccatggaaaccccagcgcagcttctcttcctcctgctactctggctcccagataccaccggagaaattgtgttgacgcagtctccaggcaccctgtctttgtctccgggggaaagagtcaccctctcctgcagggccagtcagagtgttagcggcaactacttagcctggtaccaacagaaacctggccaggctcccaggctcgtcatctatggtgcatccagcagggccactggcatcccagacaggttcagtggcagtgggtctggggacagacttcactctcaccatcagtagactggagcctgaagattttgcagtttattactgtcagcagtatgggggctcacgtcgattcactttcggccctgggaccaaagtagatgtcaaacgaactgtggctgcaccatctgtctt

SEQ ID NO: 588169 - DNA, 501 bp, Homo sapiens; identical to SEQ ID NO: 581815
  misc_feature: HIJSMM301BMHTO.13.11.A11.1.454.light.4.raw

SEQ ID NO: 588170 - DNA, 485 bp, Homo sapiens; identical to SEQ ID NO: 545589
  misc_feature: HIJSMM301D7C0V.26.70.G04.1.454.light.4.raw

SEQ ID NO: 588171 - DNA, 490 bp, Homo sapiens
  misc_feature: HIJSMM301ED16Q.5.23.C01.1.454.light.4.raw
atcagacacgcacgaccggtgctcgatttagtacacgtgattagggattgggggccagtctcagtcaggacacagcatggacatgagggtccccgctcagctcctggggctcctgctactctggctccgagatgccagatgtgacacccagatgacccagtctccatcctccctgtctgcatctgtgggagactgagtcatcatctcttgccgggcaagtcagagtgttagtatttatttaaattggtatcagttcaaaccagggaaagcccctaagctcctgatctatgctgcatccagtttacaaagtggggtcccatcaaggttcagtggcagtggatctgggacagatttcactctcaccatcagtagtctacaacctgaagattttgcaacttactactgtcaacagagttacgatacccctccgctcactttcggcggagggaccaaggtggagatcaaacgaactgtggctgcaccatctgtt

SEQ ID NO: 588172 - DNA, 487 bp, Homo sapiens; identical to SEQ ID NO: 543166
  misc_feature: HIJSMM301D4IMZ.5.23.C01.1.454.light.4.raw

SEQ ID NO: 588173 - DNA, 478 bp, Homo sapiens
  misc_feature: HIJSMM301AKPPW.13.6.A06.1.454.light.4.raw
  modified_base (466)..(466): a, c, t, g, unknown or other
tcacgtactacacgaccggtgctcgatttagatctactgacagggcagactgagcccaggatcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaaatcatgatttatgatgtcagtaagcggccctcaggggtccctgatcgcttctctgcctccaagtctggcaacacggcctccctgaccatctctgggctccaggctgaggatgagtctgattattactgctgctcatatgcaggcagctacactgtactattcggcggagggaccaagctgaccgtctaggtcagcccaaggctgcccccncggtcactctcg

SEQ ID NO: 588174 - DNA, 488 bp, Homo sapiens; identical to SEQ ID NO: 538811
  misc_feature: HIJSMM301AWX81.40.83.H06.1.454.light.4.raw

SEQ ID NO: 588175 - DNA, 505 bp, Homo sapiens; identical to SEQ ID NO: 535987
  misc_feature: HIJSMM301A4D2D.18.37.D04.1.454.light.4.raw

SEQ ID NO: 588176 - DNA, 486 bp, Homo sapiens
  misc_feature: HIJSMM301BIMT6.4.54.E10.1.454.light.4.raw
  modified_base (393)..(393): a, c, t, g, unknown or other
agcactgtagcacgaccggtgctcgatttagatcgtagcagaacacacaaaggggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcagcatcacttgccgggcaagtcagagcattagctacttttttaagtggtatcagcagacaccagggaaagcccctaagctcctgatctatgctgcttccagtttgcaaagtgggtcccatcaaggttcagtggcagtggatctgggacagatttcactctcactgtcagcagtctgctaatttgaagtnttttgctaacttactactgtcaacagatttcagtactcccttggtactttcggccgaacgggaccgaaggtaggaaatacaaacgaactgtgg

SEQ ID NO: 588177 - DNA, 501 bp, Homo sapiens; identical to SEQ ID NO: 535746
  misc_feature: HIJSMM301ETS14.18.11.A11.1.454.light.4.raw

SEQ ID NO: 588178 - DNA, 486 bp, Homo sapiens
  misc_feature: HIJSMM301DXNCI.22.73.G07.1.454.light.4.raw
acatacgcgtcacgaccggtgctcgatttagctctacgctcagggggaggaactgctcagttaggacccagacggaaccatggaagccccagcgcagcttctcttcctcctgctactctggctcccagataccactggagaaatagtgatgacgcagtctccagccaccctgtctgtgtctccaggggaaagagccaccctctcctgcagggccagtcagagtgttagcaacaacttagtctggtaccagcagagacctggccaggctcccaggctcctcatctatggtgcttctaccagggccactggtatccccgccaggttcagtgccagtgggtctgggacagagttcactctcaccatcagcagcctgcagtctgaagattttgcactttattactgtcagcaatataatgactggttctcgatcaccttcggccaagggacacgactggagattaaacgactagtggctgcacatctgtt

SEQ ID NO: 588179 - DNA, 486 bp, Homo sapiens; identical to SEQ ID NO: 535043
  misc_feature: HIJSMM301A0QBF.46.35.D02.1.454.light.4.raw

SEQ ID NO: 588180 - DNA, 496 bp, Homo sapiens
  misc_feature: HIJSMM301BQ7UB.47.46.E02.1.454.light.4.raw
agctcacgtacacgaccggtgctcgatttagactcatctacagggaaagggggaggaactgctcagttaggacccagacggaaccatggaagccccagcgcagcttctcttcctcctgctactctggctcccagagaccactggagaaatagtgatgacgcagtctccagccaccctgtctgtctctccaggggaaagagccaccatctcctggtagggccggtcagagtattagcatcaacttagcctggtaccagcagagacctgggcaggcctcccaggctcctcatctatgatgcgtccaccagggccactggtttcccagccaggttcagtggcagtgcgtctgggacagagttcactctcaccatcaacagcctgcagtctgaagattttgctagttttattactgttcagcagtatcataactggccgctcaccttcggccaagggacacgactggagaattaaacgaactgtggctgcaccatcttcg

SEQ ID NO: 588181 - DNA, 480 bp, Homo sapiens; identical to SEQ ID NO: 535291
  misc_feature: HIJSMM301BVGM9.22.59.F04.1.454.light.4.raw

SEQ ID NO: 588182 - DNA, 511 bp, Homo sapiens
  misc_feature: HIJSMM301EAPE4.48.15.B04.1.454.light.4.raw
agtatacatacacgaccggtgctcgatttagacagtatatatccgcgggggagctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatcccacccggaagtccgaggttcctgaccgattccgtggcagcgggtctgggacagattttactctcaccatcactaccctgcaggctgaagatgtggcagtttatactgtacaacaatattattctactccgccgacgttcggccggggaccgaacgtaggaatacaaacgaactgtggtctgcaccatctgtcttcta

SEQ ID NO: 588183 - DNA, 493 bp, Homo sapiens
  misc_feature: HIJSMM301A3CFW.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcagggacagatttcacactagaaaatcaggccgggtgggggctgaggatgttggcatttattactgcatgcaggctatacaccttcctgcctacttttggccgaggggaccaagctggagatcaggcgtaacg

SEQ ID NO: 588184 - DNA, 494 bp, Homo sapiens
  misc_feature: HIJSMM301EEWOS.43.29.C07.1.454.light.4.raw
tgtgagtagtcacgaccggtgctcgatttagagtgctacgaagggaaaggggggagtcagacccactcaggacacagcatggacatgagggtccccgctcagctcctggggcttctgctgctctggctcccaggtgccagatgtgccatccagttgacccagtctccatcctccctgtctgcatcagtaggagacagagtcaccatcacttgccgggcaagtcagggcattggaaccgctttagcctggtatctgcagaacccagggaaagctcctaagctcctcatctctggtgcctccactttggaaagtggggtcccatcaagattcagcggtagtggatctgggacagaattcactctcaccgtcagcagcctgcagcctgaagattttgcaacttattactgtcaacagtttaataactaccctctcactttcgaggagggaccagggtggagatacaaacgaactgtggctgcaccatctgtcttcta

SEQ ID NO: 588185 - DNA, 519 bp, Homo sapiens; identical to SEQ ID NO: 548206
  misc_feature: HIJSMM301EQOWC.22.30.C08.1.454.light.4.raw

SEQ ID NO: 588186 - DNA, 507 bp, Homo sapiens; identical to SEQ ID NO: 535641
  misc_feature: HIJSMM301BT35M.10.88.H11.1.454.light.4.raw

SEQ ID NO: 588187 - DNA, 486 bp, Homo sapiens; identical to SEQ ID NO: 535043
  misc_feature: HIJSMM301EAS1F.46.35.D02.1.454.light.4.raw

SEQ ID NO: 588188 - DNA, 521 bp, Homo sapiens
  misc_feature: HIJSMM301CVS21.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaagggaccgaacggtaggaaagtacaacgacgaactacgtggcgtcgcgaccactactcgtctttcctatcttcccgt

SEQ ID NO: 588189 - DNA, 515 bp, Homo sapiens
  misc_feature: HIJSMM301DJHNA.48.29.C07.1.454.light.4.raw
agtatacatacacgaccggtgctcgatttagagtgctacgaagggaaaggggggggagcctagctgtgctgtgggtccaggaggcagaactctgggtgtctcaccatggcctgggtccccctacttctccccctcctcactctctgcacaggctctcaggcctcctatgagttgacacagccaccctcggtgtcagtgtccccaggacagacggccaggatcacctgctctggagatggattgccaacacaatatgcgtactggtaccagaagaagccaggccaggcccctgttttggtgatatatcaagacactcagagggcctcagggacccctgagcggttctctggctccagctcaggggcaacagtcgcgttgacaatcagggaagtccaggcagaggacgaggctgactattactgtcagtctgcagacaacggaggtacttacttggtcttcggcggagggaccaagttgaacgtcctgggtcagcccaaggctgccccctcggtcta

SEQ ID NO: 588190 - DNA, 492 bp, Homo sapiens
  misc_feature: HIJSMM301CRUF0.49.53.E09.1.454.light.4.raw
agtcgagagacacgaccggtgctcgatttagagagagtgtgttgggtttgggggaggaactgctcagttaggacccagagggaaccatggaagccccagctcagcttctcttcctcctgctactctggctcccagataccaccggagaaagtgtgttgtcacagtctcctgccaccctgtctttgtctccaggggaaagagccaccctctcctgcagggccactcagagtgttagcacctacttagcctggtaccaacagagacctggccagcctcccaggctcctcatctatgatacatccaacagggccactggcatcccagccaggttcagtggcagtgggtctgggacagacttcactctcaccatcagcagcctagagcctgaagattttgcagtctattactgtcagcagcgttacaactggcctcccatgtacacttttggccaggggaccaagctggaaatcagacgaactgtggctgcaccat

SEQ ID NO: 588191 - DNA, 485 bp, Homo sapiens; identical to SEQ ID NO: 538954
  misc_feature: HIJSMM301B0HYP.3.55.E11.1.454.light.4.raw

SEQ ID NO: 588192 - DNA, 484 bp, Homo sapiens; identical to SEQ ID NO: 535400
  misc_feature: HIJSMM301AS4H6.46.26.C04.1.454.light.4.raw

SEQ ID NO: 588193 - DNA, 502 bp, Homo sapiens
  misc_feature: HIJSMM301BJY5T.9.53.E09.1.454.light.4.raw
tgatacgtctcacgaccggtgctcgatttagagagagtgtgttgggtttggggggggtcacaagaggcagcgctctcgggacgtctccaccatggcctgggctctgctgctcctcaccctcctcactcaggacacagggtcctgggcccagtctgccctgactcagcctgcctccgtgtctgggtctcctggacagtcgatcaccatctcctgcactggaaccagcagtgatgttgggagttatgaccttgtctcctggtaccaacagcacccaggcaaagcccccaaactcatcatttatgaggtcactaagcggccctcaggggtttctattcgcttctctggctccaagtctgacaacacggcctccctgacaatctctgggctccaggctgaggacgaggctgattattactgctgctcatatgcagatggtgacactcccgtggtattcggcggaggaccaaggtgaccgtctaggtcagcccaaggctgccccccg

SEQ ID NO: 588194 - DNA, 492 bp, Homo sapiens
  misc_feature: HIJSMM301DOLBF.51.57.F02.1.454.light.4.raw
cgatcgtatacacgaccggtgctcgatttagctcgatatagttgggtttggggtgggcctcaggaagcagcatcggaggtgcctcagccatggcatggatccctctcttcctcggcgtccttgcttactgcacaggatttgtggcctcctatgagctgactcagccaccctccgtgtccgtgtccccaggacagacagccagcgtcacctgctctggggataaattgcgcgatagatatgtttcctggtatcaacagaagccaggccagtcccctgtcgtggtcatctatcaagacaccaagcggccctcagggatccctgagcgattctctggctccaactctgggaacacagccactctgaccatcagcgggacgcaggctgtggatgaggctgacttttactgtcaggcgtgggacagcgacactgccgtgttcggcgggggaccaagctgaccgtcctcggtcagcccaaggctgccccctcggtcta

SEQ ID NO: 588195 - DNA, 519 bp, Homo sapiens
  misc_feature: HIJSMM301BZX2O.40.46.E02.1.454.light.4.raw
tctagcgactcacgaccggtgctcgatttagactcatctacagggaaaggggctgggcctaaggaagcagcactggtggtgcctcagccatggcctggaccgttctcctcctcggcctcctctctcactgcacagggtctgtgacctcctatgtgctgactcagccactctcggtgtctgtggccccaggacaggcggccaatgttacctgtgggggagacaacattgggagtaaaagtgtgcactggtaccagctgaagccaggccaggcccctgtgttggtcgtctttggacatggtgcccgaccctcggggatccctgagcgattctctgcctccaggtctgggaacacggccaccctgaccatcaccagggtcgaggccggagatgaggccgactattttgtcacgtgtggcacgttagtcatcacgtcttcggaactgggaccacggtcaccgtcctaagtcagcccaaggccacccactgtcactctgttcccgccctcctcagtcgctagac

SEQ ID NO: 588196 - DNA, 454 bp, Homo sapiens; identical to SEQ ID NO: 536347
  misc_feature: HIJSMM301AKXBO.19.86.H09.1.454.light.4.raw

SEQ ID NO: 588197 - DNA, 490 bp, Homo sapiens; identical to SEQ ID NO: 535234
  misc_feature: HIJSMM301BIYB4.17.21.B10.1.454.light.4.raw

SEQ ID NO: 588198 - DNA, 505 bp, Homo sapiens; identical to SEQ ID NO: 536254
  misc_feature: HIJSMM301D7XBS.7.71.G05.1.454.light.4.raw

SEQ ID NO: 588199 - DNA, 494 bp, Homo sapiens; identical to SEQ ID NO: 537607
  misc_feature: HIJSMM301A5TLJ.52.10.A10.1.454.light.4.raw

SEQ ID NO: 588200 - DNA, 495 bp, Homo sapiens; identical to SEQ ID NO: 543626
  misc_feature: HIJSMM301C1E22.40.71.G05.1.454.light.4.raw

SEQ ID NO: 588201 - DNA, 501 bp, Homo sapiens; identical to SEQ ID NO: 538461
  misc_feature: HIJSMM301BUPD0.13.11.A11.1.454.light.4.raw

SEQ ID NO: 588202 - DNA, 502 bp, Homo sapiens; identical to SEQ ID NO: 549179
  misc_feature: HIJSMM301BN7WJ.14.57.F02.1.454.light.4.raw

SEQ ID NO: 588203 - DNA, 486 bp, Homo sapiens
  misc_feature: HIJSMM301EI90J.26.55.E11.1.454.light.4.raw
agactatactcacgaccggtgctcgatttagcactcgcacgttgggtttgggggcaggagtcagtctcagtcaggacacagcatggacatgcgggtccccgctcagctcctggggctcctgctgctctggctccgaggtgccagatgtgacatccagatgacccagtctccatcctccctgtctgcatctgtaggagacagagtcaccatcacttgccgggcaagtgagggcataaacaaattcttaaattggtatcaggagaaaccagggagagcccctaaggtcctgatctatggtgcatccattttgcaaagtggggtcccaccaaatttcagtggcagtggatctgggacagatttcactctcagcattaataatctgcaacctgaggattttgcaacttactactgtcaacagagttacaggcccccctatacttttggtccaggggaccaagctggagatcacaggaactgtggctgcac

SEQ ID NO: 588204 - DNA, 484 bp, Homo sapiens; identical to SEQ ID NO: 538094
  misc_feature: HIJSMM301AVPOC.3.10.A10.1.454.light.4.raw

SEQ ID NO: 588205 - DNA, 508 bp, Homo sapiens; identical to SEQ ID NO: 535835
  misc_feature: HIJSMM301EFRV5.8.34.D01.1.454.light.4.raw

SEQ ID NO: 588206 - DNA, 487 bp, Homo sapiens; identical to SEQ ID NO: 537573
  misc_feature: HIJSMM301DCL6P.3.10.A10.1.454.light.4.raw

SEQ ID NO: 588207 - DNA, 505 bp, Homo sapiens
  misc_feature: HIJSMM301A9EBI.10.9.A09.1.454.light.4.raw
  modified_base (486)..(486): a, c, t, g, unknown or other
catagtagtgcacgaccggtgctcgatttagcgagacgcgcaggggcagagccctggggaggaactgctcagttaggacccagagggaaccatggaagccccagctcagcttctcttcctcctgctactctggctcccagtttcagataccaccggagagattgtgttgacacagtctccagccaccctgtctttgtctccaggggaaagagccaccctctcctgcagggccagtcagaatgttggcgccttcgtaagctggtaccaacacaaacctggccaggctcccaggcccctcatctatggtgcatccaacagggccactggcatcccagccaggttcagtggcagtggggtatggggacagacttcactctcaccatcatcagcctggagcctgaagatgttgcagtttattactgtcaacaatcgtaccgagtggcctccgggggccgacttcgtccctcggaccgaacgagaggatanaacgaaacatgcgtgcaca

SEQ ID NO: 588208 - DNA, 491 bp, Homo sapiens
  misc_feature: HIJSMM301AS1PD.16.72.G06.1.454.light.4.raw
tgtactactccacgaccggtgctcgatttagctacgactgcaagggaaagggggaggaactgctcagttaggacccagacggaaccatggaagccccagcgcagcttctcttcctcctgctactctggctcccagatacctctggagaaacagtgatgacgcagtctccagccaccctctctgtgtctccgaggggaaagagtcaccctctcctgcagggccagtcagagtgttagcagcaacttagcctggtatcagcagaaacctggccaggctcccaggctcctcatctatgatgcatccaccagggccactggtatcccagccaggttcagtggcagtgggtttgggacagagttcactctcaccatcagcagcctgcagtctgaagattttgctagtttattactgtcagcagtataataactggcctccggtcactttcggcggagggaccaaggtggagatcaaacgaactgtggctgcaccat

SEQ ID NO: 588209 - DNA, 501 bp, Homo sapiens
  misc_feature: HIJSMM301D2WC8.51.39.D06.1.454.light.4.raw
  modified_base (373)..(373): a, c, t, g, unknown or other
cgatcgtatacacgaccggtgctcgatttagtgacatctcgcagttctttgggggctgtgggtccaggaggcagaactctgggtgtctcaccatggcctggatccctctacttctccccctcctcactctctgcacaggctctgaggcctcctatgtgctgacacagccaccctcggtgtccgtgtccccaggacagacggccaggatcacctgctctggagatgcattgccaacccactattcttattggtaccaacagaagccaggccaggcccctgtgttgttgatatataaagacagtgagaggccttcagggatccctgagcgattctctggctccacctcgagggacactggtcacattgaaaaccntcagtggagtccaggcagaagacgaggctgactatttctgtcaatcttcagacgtcagtggtacttatgtcttcggaactgggaccaaggtcaccgtcctaggtcagcccaaggcccaaccccactgt

SEQ ID NO: 588210 - DNA, 444 bp, Homo sapiens; identical to SEQ ID NO: 535192
  misc_feature: HIJSMM301ANN9P.5.9.A09.1.454.light.4.raw

SEQ ID NO: 588211 - DNA, 483 bp, Homo sapiens
  misc_feature: HIJSMM301EPJ3Z.52.5.A05.1.454.light.4.raw
cgcagtacgacacgaccggtgctcgatttagatagatagacaggggctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggttgtgtcttttcggcggagggaccaagctgaccgtcctacgtcagcccaaggctcgccccctcc

SEQ ID NO: 588212 - DNA, 503 bp, Homo sapiens; identical to SEQ ID NO: 538884
  misc_feature: HIJSMM301AO443.27.78.H01.1.454.light.4.raw

SEQ ID NO: 588213 - DNA, 494 bp, Homo sapiens; identical to SEQ ID NO: 550126
  misc_feature: HIJSMM301BGG00.51.35.D02.1.454.light.4.raw

SEQ ID NO: 588214 - DNA, 493 bp, Homo sapiens; identical to SEQ ID NO: 535084
  misc_feature: HIJSMM301EFLWS.47.64.F09.1.454.light.4.raw

SEQ ID NO: 588215 - DNA, 473 bp, Homo sapiens; identical to SEQ ID NO: 536488
  misc_feature: HIJSMM301AVJIK.12.49.E05.1.454.light.4.raw

SEQ ID NO: 588216 - DNA, 493 bp, Homo sapiens; identical to SEQ ID NO: 535745
  misc_feature: HIJSMM301D6PUV.47.78.H01.1.454.light.4.raw

SEQ ID NO: 588217 - DNA, 495 bp, Homo sapiens
  misc_feature: HIJSMM301BECLY.13.46.E02.1.454.light.4.raw
tcacgtactacacgaccggtgctcgatttagactcatctacagggaaaggggtgatcaggactcctcagttcaccttctcacaatgaggctccctgctcagctcctggggctgctaatgctctgggtcccaggatttagaggggatgctgtaatgactcagtctccactctccctgcccgtcacccttggacagccggcctccatctcctgcagttctagtcaaagcctcgtacatcatgatgggcacacctacttgaattggtttcggcagaggccaggccaatctccaaggcgcctaatttataaggtgtctgacagggactccggggtcccagacagattcagcggcagtgggtcaggcactgatttcacactgaaaatcagcagggtggaggctgaggatgttattgggctctattattgcatgcaagcaacacaactggccgtacacttttggccaggggaccaagctggagatcaatcgaactgtggtc

SEQ ID NO: 588218 - DNA, 499 bp, Homo sapiens
  misc_feature: HIJSMM301ECKBO.10.63.F08.1.454.light.4.raw
catagtagtgcacgaccggtgctcgatttagcgatcgtataagggggaggaactgctcagttaggacccagagggaaccatggaagccccagctcagcttctcttcctcctgctactctggctcccagaaactaccgcagaaattgtgttgacacagtctccagccaccctgtctttgtctccaggggaaagagccaccctctcctgcagggccagtcagagtgtttcccgctacttagcctggtaccaacagaagcctggccaggctcccaggctcctcatgtatgatgcatccaacagggccactggcatcccagccaggttcagtggcagtgggtctgcgacagacttcactctcaccatcaacagcctagaacctgaagattttgcactttatttctgtcaccagagtcgcaactggcctccgacgttcggccaggggaccaacggtaggaggatcagacgaactgtggctgcaccatctgtcttcatcttcccg

SEQ ID NO: 588219 - DNA, 488 bp, Homo sapiens; identical to SEQ ID NO: 567795
  misc_feature: HIJSMM301BWLYW.22.73.G07.1.454.light.4.raw

SEQ ID NO: 588220 - DNA, 515 bp, Homo sapiens
  misc_feature: HIJSMM301CH4G0.43.81.H04.1.454.light.4.raw
tgtgagtagtcacgaccggtgctcgatttagtagtgtagattcgcggggtctggcgccaggggtcccttccaatatcagcaccatggcctggactcctctctttctgttcctcctcacttgctgcccagggtccaattctcagactgcggtgactcaggagccctcactgactgtgtccccaggagggacagtcactctcacctgtgcttccagcactggagcagtcaccagtgattactatgcaaactggttccagcagaaacccggacaagcacccaggtcactgatttataagacatacaacaaacactcctggacccctgcccggttttcaggctccctccttgggggcaaagctgccctgacactgtcaggtgtgcaccctgaggacgaggctgagtattactgtctgctccactttcgtactgcctgggtcttcggcgggggactcagttgaccgtcctaggtcagccaaggctgccccctcggtcactctgttcccacctcctcacta

SEQ ID NO: 588221 - DNA, 493 bp, Homo sapiens; identical to SEQ ID NO: 549048
  misc_feature: HIJSMM301ADDNT.16.86.H09.1.454.light.4.raw

SEQ ID NO: 588222 - DNA, 505 bp, Homo sapiens; identical to SEQ ID NO: 538422
  misc_feature: HIJSMM301DYYL9.19.78.H01.1.454.light.4.raw

SEQ ID NO: 588223 - DNA, 519 bp, Homo sapiens
  misc_feature: HIJSMM301DUH6M.41.19.B08.1.454.light.4.raw
tctatactatcacgaccggtgctcgatttagtgagtcagtaagggggggtctcaggaggcagcgctctcgggacgtctccaccatggcctgggctctgctatccctcaccctcctcactcagggcacagggtcctgggcccagtctgccctgactcagcctgcctccgtgactgggtctcctggacagtcgatcaccgtctcctgctctggctccagtagtgacgtcggtgcttataattttgtcgcctggtaccaacaacaccccggcgaagcccccagactcataatttatgatgtcactgatcggccctcaggggtttctaatcgcttctctggctccaagtccggcgacacggcctccctgaccatctccggcctccaggcggaggacgagggtgattatttctgcagctcatttacaaccagccacaccttgctcttcggaactgggaccacggtcatcgtcctaggtcagcccaaggccaaccccactgtcactctgttcccaccctcctcat

SEQ ID NO: 588224 - DNA, 494 bp, Homo sapiens; identical to SEQ ID NO: 537418
  misc_feature: HIJSMM301DMXOL.9.1.A01.1.454.light.4.raw

SEQ ID NO: 588225 - DNA, 486 bp, Homo sapiens; identical to SEQ ID NO: 537310
  misc_feature: HIJSMM301BYFCU.15.28.C06.1.454.light.4.raw

SEQ ID NO: 588226 - DNA, 444 bp, Homo sapiens; identical to SEQ ID NO: 544367
  misc_feature: HIJSMM301A2H8Z.2.76.G10.1.454.light.4.raw

SEQ ID NO: 588227 - DNA, 502 bp, Homo sapiens
  misc_feature: HIJSMM301ENZWU.4.39.D06.1.454.light.4.raw
  modified_base (455)..(455): a, c, t, g, unknown or other
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgcagctcatatgcaggcagttacaatgtgatattcggnggagggaccaaactgaccgtcctaggtcagcccaaggctgccccctc

SEQ ID NO: 588228 - DNA, 513 bp, Homo sapiens; identical to SEQ ID NO: 535244
  misc_feature: HIJSMM301BZNMK.17.33.C11.1.454.light.4.raw

SEQ ID NO: 588229 - DNA, 521 bp, Homo sapiens
  misc_feature: HIJSMM301DVL3U.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgtcgtccaacggaccgaacggaggaagtactaagacgaacgtacgtggctcggcaccaactctcgtcttctactcttcccgtccccg

SEQ ID NO: 588230 - DNA, 352 bp, Homo sapiens
  misc_feature: HIJSMM301DNHQB.4.67.G01.1.454.light.4.raw
agcactgtagcacgaccggtgctcgatttagagtatacatattggttactatgactttgtctcgtggtaccaacaacacccaggcaaagcccccaaactcataatttatggtgtcactaagcggccctcaggggtccctgatcgcttctctggctccaagtctggcaacatggcctccctgaccatctctgggctccaggctgaggatgaggctgattactactgctgctcctttgcaggcgcctctgtctcaggcagctatgtcttcggaactgggaccgaagttaccgtcctgggtcagcccaaggccaaccccactgtcactctgttcccgccctcctcctacagtgct

SEQ ID NO: 588231 - DNA, 492 bp, Homo sapiens; identical to SEQ ID NO: 539740
  misc_feature: HIJSMM301AWM3B.11.81.H04.1.454.light.4.raw

SEQ ID NO: 588232 - DNA, 457 bp, Homo sapiens
  misc_feature: HIJSMM301CWL46.53.29.C07.1.454.light.4.raw
cgcgtatacacacgaccggtgctcgatttagagtgctacgaagggaaaggggggcctcaggaagcagcatcggaggtgcctcagccatggcatggatccctctcttcctcggcgtccttgcttactgcacaggatgcgtggcctcctatgagctgactcagccaccctcagtgtccgtgtccccaggacagacagccagcatcacctgctctggagacaagttgggggataaatatgctggctggtatcagcagaagccaggccagtcccctgtgttagtcatctatcaagatacaaagcggccctcagggatccctgagcgattctctggctccaactctgggaacacagccactctgaccatcagcgggactcaggctatcgatgaggctgactattactgtcaggcgtgggacagccgcactggggtgttcggcggagggaccaagctgaccgt

SEQ ID NO: 588233 - DNA, 503 bp, Homo sapiens; identical to SEQ ID NO: 541454
  misc_feature: HIJSMM301BWIIE.9.12.B01.1.454.light.4.raw

SEQ ID NO: 588234 - DNA, 507 bp, Homo sapiens
  misc_feature: HIJSMM301BOMBJ.19.78.H01.1.454.light.4.raw
tactctcgtgcacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcactggaaccagcagtgatgttggaaattctaaccttgtctcctggtaccaacatcacccaaataaagcccccaaactcatcatttatgatgccactaagcggccctcaggggtttctaatcgcttctctggctccaagtctggcaacacggcctccctgacaatctctgggctccaggctgaggacgaggctgattactactgctgctcatatgcaggtcgtatctcttatgtcttcggaactgggaccaaggtcaccgtcctaggtcagcccaaggccaaccccactgtcta

SEQ ID NO: 588235 - DNA, 498 bp, Homo sapiens
  misc_feature: HIJSMM301DF4BH.41.53.E09.1.454.light.4.raw
tctatactatcacgaccggtgctcgatttagagagagtgtgttgggtttggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaaagcccccaaactcatgatttatgatgtcagtaatcggccctcaggggtttctaatcgcttctctggctccaagtctggcaacacggcctccctgaccatctctgggctccaggctgaggacgaggctgattattactgcagctcatatacaagcagcagcactctcgtggtattcggcggagggaccaagctgaccgtcctagtcagcccaaggctcg

SEQ ID NO: 588236 - DNA, 498 bp, Homo sapiens
  misc_feature: HIJSMM301ECEVL.7.5.A05.1.454.light.4.raw
cgtgtctctacacgaccggtgctcgatttagatagatagacagggggggtcgtcaggaggcagcgctctcgggacgtctccaccatggcctgggctctgctattcctcaccctcctcactcagggcacagggtcgtgggcccagtctgccctgactcagcctgcctccgtgtctgggtctcctggacagtcgatcaccatctcctgcactggaaccaccactgacgttgctggttataaatatctctcctggtatcaacaatacccaggcaaagcccccaaagtcatcatttatgatgtctataatcggccttcaggggttcctaatcgcttctctggctccaagtctggcgacacggcctccctgaccatctctgggctccaggctgaagacgaggctgattattactgcagctcatatacaggcagcagcactcaggttttcggcggagggaccaagctgacccgtcctaggtcagcccaaggctgccccctcggt

SEQ ID NO: 588237 - DNA, 502 bp, Homo sapiens; identical to SEQ ID NO: 540122
  misc_feature: HIJSMM301B4P4C.16.9.A09.1.454.light.4.raw

SEQ ID NO: 588238 - DNA, 480 bp, Homo sapiens
  misc_feature: HIJSMM301ATGEY.41.68.G02.1.454.light.4.raw
tctatactatcacgaccggtgctcgatttagtcgatagtgaagggaaagggggagtcagtcccaaccaggacacagcatggacatgagggtccctgctcagctcctggggctcctgctgctctggctctcaggtgccagatgtgacatccagatgacccagtctccaacctccctgtctgcatctgtaggagacagagtcaccatcacttgccaggccagtcaggacattagcaactatttaaattggtatcagcagaaaccagggaaagcccctaagctcctgatctacgatgcatccaatttggaatcaggggtcccatcaaggttcagtggaagtggatctgggacagattttactttcaccatcaccagcctgcagcctgaagatattgcaacatattactgtcaacagtatgataatctccctcccactttcggcggagggaccaaggtggagatcaaacgaactgtgctgcacc

SEQ ID NO: 588239 - DNA, 494 bp, Homo sapiens; identical to SEQ ID NO: 540110
  misc_feature: HIJSMM301A4PXK.51.71.G05.1.454.light.4.raw

SEQ ID NO: 588240 - DNA, 482 bp, Homo sapiens; identical to SEQ ID NO: 535796
  misc_feature: HIJSMM301B3AHV.51.64.F09.1.454.light.4.raw

SEQ ID NO: 588241 - DNA, 503 bp, Homo sapiens; identical to SEQ ID NO: 538583
  misc_feature: HIJSMM301D4VZQ.15.59.F04.1.454.light.4.raw

SEQ ID NO: 588242 - DNA, 486 bp, Homo sapiens; identical to SEQ ID NO: 553608
  misc_feature: HIJSMM301CV7JO.11.12.B01.1.454.light.4.raw

SEQ ID NO: 588243 - DNA, 483 bp, Homo sapiens
  misc_feature: HIJSMM301DRUED.3.38.D05.1.454.light.4.raw
agacgcactccacgaccggtgctcgatttagtatctgatagttgggtttgggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaaagattttgcaaacttactactgtcaacagagtttcactacccctctcactttcggcgggggaccaaggtggagatcaaacgaactgtggctgcacc

SEQ ID NO: 588244 - DNA, 488 bp, Homo sapiens
  misc_feature: HIJSMM301AENXZ.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaagggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccaacctgaggacgaggctgactattactgctcagcatgggacagcggcctcaggacttatgtcttcggaactgggacccacgttaccgtcctaggtcagcccaac

SEQ ID NO: 588245 - DNA, 493 bp, Homo sapiens
  misc_feature: HIJSMM301A0VFZ.43.4.A04.1.454.light.4.raw
tgtgagtagtcacgaccggtgctcgatttagagtagtgatcagggggaagagctgctcagttaggacccagagggaaccatggaaaccccagcgcagcttctcttcctcctgctactctggctcccagtctcagatatcaccggagaaattgtgttggcgcagtctcctggcaccctgtctttgtctccaggggagagagccacgctctcttgcagggccagtcagagtatcagtagcaactacttaacctggtaccagcagaaatctggccaggctcccaggctcctcatctacagtgcgtccaggagggcctctggcatcccagacaggttcagtggcagtgggtctgggacagacttcactctcaccatctccagactggagcctgaagattttgcagtgtattactgtcagcaatttaatacttcagtctggacgttcggccaagggaccaacggtggacgatcaaacgaactagtggctgcaccactc

SEQ ID NO: 588246 - DNA, 496 bp, Homo sapiens
  misc_feature: HIJSMM301BSWN1.19.71.G05.1.454.light.4.raw
tactctcgtgcacgaccggtgctcgatttagtgtcgtcgcaagagagagggggggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagttttattattgtcaacaatattattatacttcgtggacgttcggccaagggaccaaggtggatatcagacgaactgtggctgca

SEQ ID NO: 588247 - DNA, 491 bp, Homo sapiens
  misc_feature: HIJSMM301BZBOG.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcacccggacgtcgcaggacaagtgagcaacgactagtgctgcacatctgtcttcatcttccgtccact

SEQ ID NO: 588248 - DNA, 491 bp, Homo sapiens; identical to SEQ ID NO: 535294
  misc_feature: HIJSMM301DT90R.16.68.G02.1.454.light.4.raw

SEQ ID NO: 588249 - DNA, 487 bp, Homo sapiens; identical to SEQ ID NO: 535583
  misc_feature: HIJSMM301AOIY6.22.73.G07.1.454.light.4.raw

SEQ ID NO: 588250 - DNA, 517 bp, Homo sapiens
  misc_feature: HIJSMM301ARDLI.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggtcgttcggtccgaagggaccgaacggtaggaaaagtacaaaacgaactagtggcgtgcaccatctgtcttctatcttccccg

SEQ ID NO: 588251 - DNA, 486 bp, Homo sapiens; identical to SEQ ID NO: 535043
  misc_feature: HIJSMM301EPYG4.46.35.D02.1.454.light.4.raw

SEQ ID NO: 588252 - DNA, 491 bp, Homo sapiens
  misc_feature: HIJSMM301C5INW.41.11.A11.1.454.light.4.raw
tctatactatcacgaccggtgctcgatttagctacgactgcaggggaggaactgctcagttaggacccagacggaaccatggaagccccagcgcagcttctcttcctcctgctactctggctcccagataccactggagaaatagtggtgacgcagtctccagccaccctgtctgtgtctccaggggaaggagccaccctctcctgcagggccagtcagagtattagcagcagcttagcctggtaccagcagaagcctggccaggctcccaggctcctcgtctatggtgcatccaccagggccactggtatcccagccaggttcagtggcagtgggtctgggacagagttcactctcaccatcaccagcctgcagtctgaagattttggagtttatttctgtcaccagtataaggactggccttcggaactttggtccgagggaccgaagactggagatcagacgaactgtggctgcacatctgtcttcta

SEQ ID NO: 588253 - DNA, 447 bp, Homo sapiens; identical to SEQ ID NO: 535020
  misc_feature: HIJSMM301DO8X0.18.9.A09.1.454.light.4.raw

SEQ ID NO: 588254 - DNA, 521 bp, Homo sapiens; identical to SEQ ID NO: 539470
  misc_feature: HIJSMM301AV6I8.27.23.C01.1.454.light.4.raw

SEQ ID NO: 588255 - DNA, 475 bp, Homo sapiens; identical to SEQ ID NO: 544617
  misc_feature: HIJSMM301EC6RY.13.76.G10.1.454.light.4.raw

SEQ ID NO: 588256 - DNA, 505 bp, Homo sapiens; identical to SEQ ID NO: 541350
  misc_feature: HIJSMM301DTJKH.2.71.G05.1.454.light.4.raw

SEQ ID NO: 588257 - DNA, 515 bp, Homo sapiens
  misc_feature: HIJSMM301APBO3.48.14.B03.1.454.light.4.raw
agtatacatacacgaccggtgctcgatttagtgtgagtagttccgcgggggatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtggaataaacgaaactgtggctgcaccatctgtcttcatcttccccg

SEQ ID NO: 588258 - DNA, 488 bp, Homo sapiens; identical to SEQ ID NO: 541295
  misc_feature: HIJSMM301ASTJI.9.59.F04.1.454.light.4.raw

SEQ ID NO: 588259 - DNA, 506 bp, Homo sapiens
  misc_feature: HIJSMM301DOJCV.11.57.F02.1.454.light.4.raw
cgagagataccacgaccggtgctcgatttagctcgatatagttgggtttggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggccaagggaccaaggtgaagtcaagcgaactgtggctgcaccatctgtcttcatcttcccgcc

SEQ ID NO: 588260 - DNA, 488 bp, Homo sapiens; identical to SEQ ID NO: 545695
  misc_feature: HIJSMM301CFQUJ.46.26.C04.1.454.light.4.raw

SEQ ID NO: 588261 - DNA, 486 bp, Homo sapiens; identical to SEQ ID NO: 535917
  misc_feature: HIJSMM301EE2CH.3.10.A10.1.454.light.4.raw

SEQ ID NO: 588262 - DNA, 505 bp, Homo sapiens; identical to SEQ ID NO: 546412
  misc_feature: HIJSMM301DT42X.22.21.B10.1.454.light.4.raw

SEQ ID NO: 588263 - DNA, 445 bp, Homo sapiens
  misc_feature: HIJSMM301ETGLY.8.73.G07.1.454.light.4.raw
ctcgcgtgtccacgaccggtgctcgatttagctctacgctcagggtcctgggcccagtctgtactgacgcagccgccctcagtatctggggccccagggcagagggtctccatctcctgcactgggagcagaaccagcatcggggcaggttatgatgttcattggtaccgccaggttccaggcacagcccccagactcctcattaatgataacaacaatcggccctcaggggtctctgaccgattctctgcctccaagtctggcacttctgcctccctggtcatatctggtctccagggtgaggatgaggctgattattactgccactcctatgacaacagcctgagtatttggctgttcggcggcgggaccaagttgaccgtcctacgtcagcccaaggctgccccctcggtcactctgttcccgccctcctcgacacgccgag

SEQ ID NO: 588264 - DNA, 494 bp, Homo sapiens; identical to SEQ ID NO: 534994
  misc_feature: HIJSMM301BK425.27.78.H01.1.454.light.4.raw

SEQ ID NO: 588265 - DNA, 524 bp, Homo sapiens
  misc_feature: HIJSMM301CY3FU.18.59.F04.1.454.light.4.raw
  modified_base (436)..(436): a, c, t, g, unknown or other
tacgagtatgcacgaccggtgctcgatttagtacacacacttagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcactaatcggccctcaggggtttctaatcgcttctctggctccaagtctggcaacacggcctccctgaccatctctgggctccaggctgaggacgaggctgattattactgcagctcatatacaagcacncacacactcaatcgttcgtacgtacggtacggaacgtacggtacctaccgtcgtacgtacgaccgaccgaccgaaccccaaccctacg

SEQ ID NO: 588266 - DNA, 511 bp, Homo sapiens
  misc_feature: HIJSMM301EQOZJ.43.15.B04.1.454.light.4.raw
tgtgagtagtcacgaccggtgctcgatttagacagtatatatccgcgggggggtcagagctctggggaggaactgctcagttaggacccagacggaaccatggaagccccagcgcagcttctcttcctcctgctactctggctcccagaaaccactggagaaatagtgatgacgcagtctccagccaccctgtctttgtctccaggggaaagagccaccctctcatgcagggccagtcagagtgttagcaccaacgtggcctggtaccagcagaaacctggccagcctccccggctcctcatctctggtgcatcctccagggccactggttccccagccaggttcagtggcagtgggtctgggacagagttcactctcaccatcagcagccttcagtctgaagattttgcagtttattactgtcaccagtatcataactggcctccaagggggactttcggccaagggaccaaggtaggaattcaaccgaactgtggctgcaccatcttcg

SEQ ID NO: 588267 - DNA, 505 bp, Homo sapiens
  misc_feature: HIJSMM301EYITT.18.78.H01.1.454.light.4.raw
tacgagtatgcacgaccggtgctcgatttagtgtgagtagtttgggtttggggggggtctcaggaggcagcgctctcgggacgtctccaccatggcctgggctctgctattcctcaccctcctcactcagggcacagggtcctgggcccagtctgccctgactcaacctgcctccgtgtctgggtctcctggacagtcgatcaccatctcctgcactggaaccagcagtgacgttggtggttataactatgtctcctggtaccaacagcacccaggcaaagcccccaaactcatgatttatgatgtcagtaatcggccctcagggtttctaatcgcttctctggctccaagtctggcaacacggcctccctgaccatctctgggctccaggctgaggacgaggctgattattactgcagctcatatacaagcagcagcactcaagtcttcggaactgggaccaaggtcaccgtcctaggtcagcccaaggcccaacccactgtca

SEQ ID NO: 588268 - DNA, 509 bp, Homo sapiens
  misc_feature: HIJSMM301ANKI9.8.34.D01.1.454.light.4.raw
ctcgcgtgtccacgaccggtgctcgatttagatcgtctgtgttgggtttgggggaggaactgctcagttaggacccagagggaaccatggaagccccagctcagcttctcttcctcctgctactctggctcccagtttcagataccaccggagagattgtgttgacacaatctccagccaccctgtcttcgtctccaggggaaagagccaccctctcctgcagggccagtcagaatgttggcgcctacgtatcctggtaccaacagaaacctggccaggctcccaggcccctcatctatggtgcatccaacagggccactggcatcccagccaggttcagtggcagtgggtatgggacagacttcactctcaccatcatcagcctggagcctgaggatgttgcagtttattactgtcaacatcgtaccgagtggcctccgggggccactttcggccctgggaccaaagtggatatcaaacgaactagtggctgcaccatctgtcttcta

SEQ ID NO: 588269 - DNA, 498 bp, Homo sapiens; identical to SEQ ID NO: 578989
  misc_feature: HIJSMM301DFAXX.43.34.D01.1.454.light.4.raw

SEQ ID NO: 588270 - DNA, 514 bp, Homo sapiens
  misc_feature: HIJSMM301BZD11.17.33.C11.1.454.light.4.raw
cgtagactagcacgaccggtgctcgatttagagtgagctcgttgggtttgggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggagcagtcaccagtgcttactatccaaactggttccagcagaaacctggacaagcacccagggcactcatttatagtacaaacaacaaacactcctggacccctgcccgattctcaggctccctccttgggggcaaagctgccctgtacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcct

SEQ ID NO: 588271 - DNA, 354 bp, Homo sapiens; identical to SEQ ID NO: 535026
  misc_feature: HIJSMM301DF5ID.19.22.B11.1.454.light.4.raw

SEQ ID NO: 588272 - DNA, 495 bp, Homo sapiens
  misc_feature: HIJSMM301ALQHZ.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaaatagcctggaagctgaagatgctgcaacttattactgtcatcagagtactactttacctcaagtgatcaccttcggccaagggacacgactggagattaaacgaactgtggctgcaccatctgtctt

SEQ ID NO: 588273 - DNA, 495 bp, Homo sapiens
  misc_feature: HIJSMM301BUJ7C.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggagtgggaccatggtcaccgtcctaggtcagcccaagaccaacccactgt

SEQ ID NO: 588274 - DNA, 491 bp, Homo sapiens; identical to SEQ ID NO: 535294
  misc_feature: HIJSMM301EYSLB.16.68.G02.1.454.light.4.raw

SEQ ID NO: 588275 - DNA, 496 bp, Homo sapiens; identical to SEQ ID NO: 535541
  misc_feature: HIJSMM301A11AP.3.33.C11.1.454.light.4.raw

SEQ ID NO: 588276 - DNA, 486 bp, Homo sapiens; identical to SEQ ID NO: 565068
  misc_feature: HIJSMM301DHQ4F.8.74.G08.1.454.light.4.raw

SEQ ID NO: 588277 - DNA, 484 bp, Homo sapiens
  misc_feature: HIJSMM301EEWBB.17.26.C04.1.454.light.4.raw
cgtagactagcacgaccggtgctcgatttagtctagcgactttgggtttggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaaattggtatcagcagaaaccagggaaagcccctaagctcctgatctttgctgcatccagtttgcaaagtggggtcccttcaaggttcagtggcagtggatctgggacagatttcactctcaccatcagcagtctgcaacctgaagattttgcaacttactactgtcaacagagttacaatacccctcggctcactttcggcggagggaccaaggtgaggatcaaacgaactgtggctgcac

SEQ ID NO: 588278 - DNA, 502 bp, Homo sapiens
  misc_feature: HIJSMM301CJS11.43.60.F05.1.454.light.4.raw
tgtgagtagtcacgaccggtgctcgatttagtacgtcatcagggaaagggggagtcagacccactcaggacacagcatggacatgagggtccccgctcagctcctggggctcctgctgctctggctcccaggtgccagatgtgccatccagatgacccagtctccgtcctccctgtctgtatctgtaggagacaaagtcaccatcacttgccgggcaagtcaggacattagaaatgaattagcctggtttcagcagaaaccagggaaagcccctaagctcctgatctatgctgcatccactttacaaaatggagtcccatcaagattcagcggcagtggatctggcacagctttcactctcaccgtcagcagcctgcagtctgaagattttgctaacttattactgtctacaagattcttcttaccctcggacgttcgtccgacgggaccgacggtcggagtggttcaacgacgaactaggtggcgtgccaccactacttcg

SEQ ID NO: 588279 - DNA, 524 bp, Homo sapiens
  misc_feature: HIJSMM301BRFR8.9.38.D05.1.454.light.4.raw
tgatacgtctcacgaccggtgctcgatttagtatctgatagttgggtttggggggggtctcaggaggcagcgctctcgggacgtctccaccatggcctgggctctgctattcctcaccctcctcactcagggcacagggtcctggacccagtctgccctgactcaacctgcctccgtgtctgggtctcctggacagtcgatcaccatctcctgcactggaaccagcagtgacattggtattaactatgtctcctggtaccaacaataccccggcaaagcccccaaactcttgctttatgatgtcagttatcggccctcaggagtttctgatcgcttctctggctccaagtctggcaccacggcctccctgaccatctctgggctccaggctgaggacgaggctgattatttctgcagctcaaaaagaagtagccctctcgtggttttcggcgggggaccaaggtgaccgtcctaagtcagcccaaggctgccccctcggtcactctgttcccaccctcctcacg

SEQ ID NO: 588280 - DNA, 441 bp, Homo sapiens; identical to SEQ ID NO: 534971
  misc_feature: HIJSMM301ANRML.11.3.A03.1.454.light.4.raw

SEQ ID NO: 588281 - DNA, 495 bp, Homo sapiens; identical to SEQ ID NO: 535486
  misc_feature: HIJSMM301AGFT6.26.72.G06.1.454.light.4.raw

SEQ ID NO: 588282 - DNA, 445 bp, Homo sapiens; identical to SEQ ID NO: 557838
  misc_feature: HIJSMM301A9ZBE.2.76.G10.1.454.light.4.raw

SEQ ID NO: 588283 - DNA, 490 bp, Homo sapiens; identical to SEQ ID NO: 535526
  misc_feature: HIJSMM301CQ3XS.26.78.H01.1.454.light.4.raw

SEQ ID NO: 588284 - DNA, 486 bp, Homo sapiens; identical to SEQ ID NO: 535043
  misc_feature: HIJSMM301CWMFP.46.35.D02.1.454.light.4.raw

SEQ ID NO: 588285 - DNA, 486 bp, Homo sapiens; identical to SEQ ID NO: 535043
  misc_feature: HIJSMM301BGS7V.46.35.D02.1.454.light.4.raw

SEQ ID NO: 588286 - DNA, 486 bp, Homo sapiens; identical to SEQ ID NO: 535043
  misc_feature: HIJSMM301D2TFN.46.35.D02.1.454.light.4.raw

SEQ ID NO: 588287 - DNA, 475 bp, Homo sapiens
  misc_feature: HIJSMM301BTMCY.12.49.E05.1.454.light.4.raw
  modified_base (438)..(438): a, c, t, g, unknown or other
atacgacgtacacgaccggtgctcgatttagagcgactagcaacacacaaagggggcagaagtctctctcagtcaggacacagcatggacatgagggtccctgctcagctcctgggactcctgctgctctggctcccagataccagatgtgacatcgagatgacccagtctccatcctccctgtctgcatctgtaggagacagagtcaccatcacttgccgggcgagtcagggcattagcaattttttagcctggtatcagcagaaaccagggaaagttccacacctcctgatctatgctgcatccgctttgcaatcaggggtcccatctcggttcagcggcagtggatctgggacagagttcactctcaccatcagcagcctgcagcctgaagatgttgcaacttattactgtcaaaagtataacagtgcccccttnacccttcggccaagggacacgactggagattagaacg

SEQ ID NO: 588288 - DNA, 480 bp, Homo sapiens; identical to SEQ ID NO: 535291
  misc_feature: HIJSMM301A00TL.22.59.F04.1.454.light.4.raw

SEQ ID NO: 588289 - DNA, 455 bp, Homo sapiens; identical to SEQ ID NO: 565939
  misc_feature: HIJSMM301D76CJ.19.86.H09.1.454.light.4.raw

SEQ ID NO: 588290 - DNA, 491 bp, Homo sapiens; identical to SEQ ID NO: 536211
  misc_feature: HIJSMM301EUD99.16.53.E09.1.454.light.4.raw

SEQ ID NO: 588291 - DNA, 500 bp, Homo sapiens
  misc_feature: HIJSMM301C08B8.11.59.F04.1.454.light.4.raw
cgagagataccacgaccggtgctcgatttagtacacacacttaggggctggggtctcaggaggcagcactctcgggacgtctccaccatggcctgggctctgctcctcctcagcctcctcactcagggcacagggtcctgggcccagtctgccctgactcagcctccctccgcgtccgggtctcctggacagtcagtcaccatctcctgcactggaaccagcagtgacattggtggttataactatgtctcctggtaccaacaacacccagacaaagcccccaaactcatgatttatgaggtcactaagcggccctcaggggtccctgatcgcttctctggctccaagtctggcaacacggcctccctgaccgtctctgggctccaggctgacgatgaggctgattattattgcagctcatatgcaggcagcaccaatttggtgttcggcggagggaccaagctgaccgtcctaggtcagcccaaggctgccccctcggt

SEQ ID NO: 588292 - DNA, 504 bp, Homo sapiens
  misc_feature: HIJSMM301BAUXP.15.86.H09.1.454.light.4.raw
  modified_base (400)..(400): a, c, t, g, unknown or other
tctacgtagccacgaccggtgctcgatttagtgctatagacttgggtttggggggacttccctggtctccttctacctactgcccttcattttctccacaggtctctgtgctctgcctgtgctgactcagcccccgtctgcatctgccttgctgggagcctcgatcaagctcacctgcaccctaagtagtgagcatcgaacctacaccatcgaatggtatcaacagagaccagggaagtccccccagtatataatgaaagttaagagtgatggcagccacaccaagggggacgggatccccgatcgcttcatgggctccagttctggggctgaccgctacctcaccatctccaacctccagtctgacgatgaggctgagtatcactgtggagagagccanacaattgatggccaagacggttgggtgttcggcggagggaccaagctgaccgtcctaggtcagcccaaggctgccccctggtcactctgttcccaccctcctcg

SEQ ID NO: 588293 - DNA, 481 bp, Homo sapiens
  misc_feature: HIJSMM301BELC1.5.39.D06.1.454.light.4.raw
atcagacacgcacgaccggtgctcgatttagtgacatctcgcagttctttgggggagtcagactcagtcaggacacagcatggacatgagggtccccgctcagctcctggggctcctgctgctctggctcccaggtgccgagggtgacatccagctgacccagtctccctccaccgtgtctgcatccgtaggagacagagtcaccatcacctgccgggccagtcagaatattaatagttggttggcctggtatcaccagaggccaggagaggccccaaagctccttatttatgatgcctccactttgattagtggggtcccaccaacgttcagcggcagtggatctgggacagagttcactctcaccatcagcagcctgcagcctgatgatcttggaacttatactgccaacaatataatagttattggacgttcggccaggggaccaaggtcgaaatgagacgaactgtggctgcaccat

SEQ ID NO: 588294 - DNA, 471 bp, Homo sapiens
  misc_feature: HIJSMM301CBFF1.3.38.D05.1.454.light.4.raw
agacgcactccacgaccggtgctcgatttagtatctgatagttgggtttgggggcaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcaacagtctgcaacctgaagattttgcaacttactactgtcaacagagtttcactaccctctcactttcggcgggggaccaaggtggagatcaaacgaa

SEQ ID NO: 588295 - DNA, 495 bp, Homo sapiens
  misc_feature: HIJSMM301EZYY3.3.36.D03.1.454.light.4.raw
agacgcactccacgaccggtgctcgatttagctgcgtcacgatctctcttgggggaggaactgctcagttaggacccagagggaaccatggaaaccccagcgcagcttctcttcctcctgctactctggctcccagatacgaccggagaaattgtgttgacgcagtctccagccaccctgtctttgtctccaggggagagagccaccctctcctgcggggccagtcagagtgttcccagcaactatatagcctggtaccagcacaaagttggcctggcgcccaggctcctcatctatgatacattcaccagggccactggcatcccggacaggttcagaggcagtgggtatgggacagacttcactctcaccatcagcagactggagcctggagattttgcagtttattactgtcagcagtatggtacttcacaaaaccttcggccaggggacacgactggagattaagcgaactgtggctgcaccatctgtctt

SEQ ID NO: 588296 - DNA, 501 bp, Homo sapiens; identical to SEQ ID NO: 545045
  misc_feature: HIJSMM301EOBDU.52.35.D02.1.454.light.4.raw

SEQ ID NO: 588297 - DNA, 454 bp, Homo sapiens; identical to SEQ ID NO: 534964
  misc_feature: HIJSMM301EJZYJ.19.86.H09.1.454.light.4.raw

SEQ ID NO: 588298 - DNA, 486 bp, Homo sapiens; identical to SEQ ID NO: 535043
  misc_feature: HIJSMM301AWHXC.46.35.D02.1.454.light.4.raw

SEQ ID NO: 588299 - DNA, 487 bp, Homo sapiens
  misc_feature: HIJSMM301D6IZK.47.70.G04.1.454.light.4.raw
agctcacgtacacgaccggtgctcgatttagtgtagtgtgaagggaaagggggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaacagcgatttaaattggtatcaccagaaaccagggaaagcccctaacctcctgatctatgctgcatccagtttgcatagtggggtcccatctaggttcagtggcagtggatctgggacagatttcactctcaccatcagcagtctgcaacctgaagattttgcaacttactactgtcaacagagttacggtaccccgtacaccttttggccaggggaccaaactggacatcaaacgaactgtggctgcacatctgt

SEQ ID NO: 588300 - DNA, 503 bp, Homo sapiens; identical to SEQ ID NO: 538583
  misc_feature: HIJSMM301BSFJN.15.59.F04.1.454.light.4.raw

SEQ ID NO: 588301 - DNA, 486 bp, Homo sapiens; identical to SEQ ID NO: 535043
  misc_feature: HIJSMM301BCIOG.46.35.D02.1.454.light.4.raw

SEQ ID NO: 588302 - DNA, 524 bp, Homo sapiens
  misc_feature: HIJSMM301EKFA5.27.23.C01.1.454.light.4.raw
agcgtcgtctcacgaccggtgctcgatttagtacacgtgattagggattggggggggtctcaggaggcagcgctctcgggacgtctccaccatggcccgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgaccgtcctaggtcagcccaaggctgccccctcggtcactctgttcccgccctcct

SEQ ID NO: 588303 - DNA, 472 bp, Homo sapiens; identical to SEQ ID NO: 550621
  misc_feature: HIJSMM301AYCTE.41.8.A08.1.454.light.4.raw

SEQ ID NO: 588304 - DNA, 491 bp, Homo sapiens
  misc_feature: HIJSMM301B0KYG.17.21.B10.1.454.light.4.raw
cgtagactagcacgaccggtgctcgatttagtgtcgtcgcaaggggactgatcaggactcctcagttcaccttctcacaatgaggctccctgctcagctcctggggctgctaatgctctgggtcccagcatccagtggggatgttgtgatgactcagtctccactctccctgcccgtcacccttggacagccggcctccatctcctgcaggtctagtcaaagcctcgtccacagtgatggaaacatctacttcatgtggtttcagcagaggccgggccaatctccaaggcgtcttatttataaggtctctgaccgggactctggggtcccagacagattcagcggcagtgggtcagacactgatttcacactgaaaatcagcagggtggaggctgaggatgtcggggtttactactgcatgcagggtacactctggccgttcacttttggccaggggaccaaacgtggatatcagacgaactgtggctgca

SEQ ID NO: 588305 - DNA, 494 bp, Homo sapiens; identical to SEQ ID NO: 534994
  misc_feature: HIJSMM301BD3RG.27.78.H01.1.454.light.4.raw

SEQ ID NO: 588306 - DNA, 457 bp, Homo sapiens
  misc_feature: HIJSMM301DH268.22.28.C06.1.454.light.4.raw
acatacgcgtcacgaccggtgctcgatttagagctcacgtattgggtttgggggccgtccctgggcccagtctgtgttgactcagccaccctcagcgtctgggacccccgggcagagggtcaccatctcttgttctggaagcgactccaacatcggcgatacttatgtgtactggtaccaacaggtcccagggacggccccaaactcctcatgtatgacagtagtgagcggccctcaggggtccctgaccgattctctggctctaagtctggcacctcggcctccctggacatcagtggcctccggtccgaggatgaggctgattattactgtgcagcatgggattacaacctgagtgatcctagttgggtgttcggcggagggaccaggctgaccgtcctaggtcagcccaaggctgcccctcggcactctgttcccgccctcctcacgcgtatgt

SEQ ID NO: 588307 - DNA, 486 bp, Homo sapiens; identical to SEQ ID NO: 539294
  misc_feature: HIJSMM301DN1I2.12.33.C11.1.454.light.4.raw

SEQ ID NO: 588308 - DNA, 479 bp, Homo sapiens
  misc_feature: HIJSMM301AM53W.43.12.B01.1.454.light.4.raw
tgtgagtagtcacgaccggtgctcgatttagtagtgtagattccgcgggggagtcagacccagtcaggacacagcatggacatgagggtccccgctcagctcctggggctcctgctgctctggttcccaggttccagatgcgacatccagctgacccagtctccatcttctgtgtctgcatctgtgggagacacagtcaccatcacttgtcgggcgagtcaagttattagtaactggttagcctggtatcagcagaaaccaggaaaagcccctaaactcctgatctatgctgcatccaggttgcagagtggggtcccatcaagattcagcggcagtggatctgggacagatttcactctcactatcagcagcctgcagcctgaagatttgccacttactattgtcaacaggctgacagtttccccttcaccttcggccaagggacacgactggacattaaacgaaactgtggctgcacc

SEQ ID NO: 588309 - DNA, 505 bp, Homo sapiens; identical to SEQ ID NO: 536254
  misc_feature: HIJSMM301EEHHW.7.71.G05.1.454.light.4.raw

SEQ ID NO: 588310 - DNA, 517 bp, Homo sapiens
  misc_feature: HIJSMM301CJQNF.14.78.H01.1.454.light.4.raw
cgtctagtaccacgaccggtgctcgatttagtgtgagtagtttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgcaactaatggtgagattgggacttataaccttgtctcctggtaccaacaacatccagacaaagcccccaaactcatcatttatgagaccactaagcggccctcaggggtttctgatcgcttctctgcctccaagtctggccacacggcctccctgacaatctctgggctccagactgaggacgagggtgattattactgctgctcatacggagggactagaactttgctattcggcggagggaccaagttgaccgtcctaagtcagcccaaggctgccccctggtcactctgttccccg

SEQ ID NO: 588311 - DNA, 476 bp, Homo sapiens; identical to SEQ ID NO: 538611
  misc_feature: HIJSMM301B2FFN.7.81.H04.1.454.light.4.raw

SEQ ID NO: 588312 - DNA, 520 bp, Homo sapiens
  misc_feature: HIJSMM301ARYS9.10.28.C06.1.454.light.4.raw
catagtagtgcacgaccggtgctcgatttagagctcacgtattgggtttggggggggtctcaggaggcggccctctcgggacgtctccaccatggcctgggctctgctattcctcaccctcctcactcagggcacagggtcctgggcccagtctgccctgactcagcctgcctccgtgtctgggtctcctggacagtccatcaccatctcctgcactggacccaccagttacattggtaataatgaatatgtctcctggtaccaacagtacccaggcaaagcccccaaactgatgatttatgatgtcagtaatcgaccctcaggggtttctgatcgcttctttgcctccaagtctggcaacacggcctccctgaccatctctgggctccagactgaggacgaggctgattattactgcagctcacatacaagcggcagcggttgggtggttcggcggggggaccgacactgaccgtcctaggtcagcccaaggctgccccctcggtcactctgttccccg

SEQ ID NO: 588313 - DNA, 510 bp, Homo sapiens; identical to SEQ ID NO: 542037
  misc_feature: HIJSMM301AJGFG.4.57.F02.1.454.light.4.raw

SEQ ID NO: 588314 - DNA, 491 bp, Homo sapiens; identical to SEQ ID NO: 535294
  misc_feature: HIJSMM301EHI7P.16.68.G02.1.454.light.4.raw

SEQ ID NO: 588315 - DNA, 492 bp, Homo sapiens; identical to SEQ ID NO: 537395
  misc_feature: HIJSMM301CM6CM.16.73.G07.1.454.light.4.raw

SEQ ID NO: 588316 - DNA, 503 bp, Homo sapiens; identical to SEQ ID NO: 572925
  misc_feature: HIJSMM301BG203.14.57.F02.1.454.light.4.raw

SEQ ID NO: 588317 - DNA, 499 bp, Homo sapiens
  misc_feature: HIJSMM301D4RIY.12.87.H10.1.454.light.4.raw
atacgacgtacacgaccggtgctcgatttagcagtactgcgttgggtttggggctgggcctcaggaagcagcatcggaggtgcctcagccatggcatggatccctctcttcctcggcgtccttgcttactgcacaggttccgtggcctcgtatgacctgactcagccaccctctgtgtccgtgtccccaggacagacagtcacaatctcatgctctggagatgcattgggggaaaagtttgctttctggtatcagcagaagccaggccagtcccctgtcttggtcatctataaggatagcaggcggccctcagggattcctgagcgattctccggctccaactccggcaacacagccactctgaccatcagcgggacccaggctctcgatgaggctgactattactgccaggcgtgggacagctccacttcccgttatgtcttcggaggtgggaccatggtcaccgtcctaggtcagcccaagacccaaccccactcgt

SEQ ID NO: 588318 - DNA, 500 bp, Homo sapiens
  misc_feature: HIJSMM301CWZTF.43.38.D05.1.454.light.4.raw
tgtgagtagtcacgaccggtgctcgatttagtatctgatagttgggtttggggagacccagtcaggacacagcctggacatgagggtccccgctcagctcctggggctcctgctgctctggctcccaggtgccaaatgtgacatccagatgacccagtctccttccaccctgtctgcatctgtaggagacagagtcaccatcacttgccgggccagtcagactattattacctggttggcctggtatcagcagaaaccagggaaagcccctaaactcctgatctttgaggcatctcgtttagaaagtggggtcccctcaaggttcagcggcagtgcatctgggacagatttcactctcaccatcagcagcctgcagcctgatgattttgcaacttattactgtcaacagtataatagttacccctggacgttcggccaagggaccagggtggaatcaaacgaactagtggctgcaccatctgtcttcatcttcccgccta

SEQ ID NO: 588319 - DNA, 507 bp, Homo sapiens
  misc_feature: HIJSMM301C0ED7.12.28.C06.1.454.light.4.raw
atacgacgtacacgaccggtgctcgatttagagctcacgtattgggtttgggggagtcagtctcagtcaggacacagcatggacatgagggtccccgcccagctcctggggctcctgctactctggctccgaggtgccagatgtgacatccagatgacccagtcgccatccttcctttctgcttccgtgggggacagagtcaccatcacttgccgggcaagtcaaaatataatcacatatttaaattggtatcaacagaagccagggaaagcccctacactcctaatctttcttgaatccagtttgcaaaatggtgtcccatcaaggttcagtgcagtggatctgggacacaattcactctcaccatcgctgatctgcagcctgaagattttgcaacttactactgtacaacagagtttcagtcgtcccccggacgttcgtccgacgggaccacgagtagaatagagacgaactgtaggcgtgcgaccatctcgtcttcatcttccc

SEQ ID NO: 588320 - DNA, 502 bp, Homo sapiens
  misc_feature: HIJSMM301CZZIV.22.5.A05.1.454.light.4.raw
acatacgcgtcacgaccggtgctcgatttagatagatagacagggggaggaactgctcagttaggacccaggagggaaccatggaacgccccagctcagcttctcttcctcctgctactctggctcccagaaaccaccggagaagttgtgttgacacagtctccagccaccctgtctttgtctccgaggggaaagagccaccctctcctgcagggccagtcagagtgttaactactacttagcctggtaccaacagaaacctggccaggctcccaggctcctcatctatgatgcatcttacagggccactggcatcccagccaggttcagtggcaggtgggtctgggacagacttcactctcaccatcagcagcctagagcctgaagtattttgctagtttattactgtcagcagcgtagcaactccctcacgttcggcggagggaccaaggtggagatacaaacgaactgtggctgcaccatctgtcttcatcttcccgcc

SEQ ID NO: 588321 - DNA, 496 bp, Homo sapiens; identical to SEQ ID NO: 536326
  misc_feature: HIJSMM301B0P2J.16.12.B01.1.454.light.4.raw

SEQ ID NO: 588322 - DNA, 483 bp, Homo sapiens
  misc_feature: HIJSMM301A2ZFP.52.22.B11.1.454.light.4.raw
cgcagtacgacacgaccggtgctcgatttagacgacagctcaggggaggagtcagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcatttgccgggcaagtcagagtattagcagctatttaaattggtatcaacataccccggggaaggcccctaagttactgatctatgctgcagccaatttgcaaagtggggtcccatcaaggttcagtggcagtggatctgggacagaattcactctcaccatcagcagtctgcaacctgaagattttggaaagtactattgtcaacagagttacggaaacttgctcattttcggcggagggaccaaggtggagatcaaacgaactgtggctgcaccatctgt

SEQ ID NO: 588323 - DNA, 508 bp, Homo sapiens; identical to SEQ ID NO: 536388
  misc_feature: HIJSMM301CSD7N.11.57.F02.1.454.light.4.raw

SEQ ID NO: 588324 - DNA, 500 bp, Homo sapiens
  misc_feature: HIJSMM301EW1EP.52.78.H01.1.454.light.4.raw
cgcagtacgacacgaccggtgctcgatttagtgtgagtagtttgggtttgggggtgggtccaggaggcagaactctgggtgtctcaccatggcctggatccctctacttctccccctcctcactctctgcacaggctctggggcctcctatgaactgacacagccaccctcggtgtcagtgtcctcaggacagacggccaggatcacctgctctggagatgcactgccaaagcaatatggttattggtaccagcagaggccaggccaggcccccttattggtgatatataaggaccatgagaggccctcagggatccctgagcgattctctggctcctctcagggacaacagtcacgttgatcatcagtggagtccgggcaggaggacgaggctgactattactgtcaatcaacagacagtagtggtacttatgtgcagttcggcggagggaccaagctgaccgtctaggtcagcccaaggctgccccctcggtcactcc

SEQ ID NO: 588325 - DNA, 484 bp, Homo sapiens
  misc_feature: HIJSMM301D8QKP.19.57.F02.1.454.light.4.raw
tactctcgtgcacgaccggtgctcgatttagctcgatatagttgggtttgggggagtcagacccagtcaggacacagcatggacatgagggtccccgctcagctcctggggctcctgctgctctggttcccaggttccagatgcgacatccagatgacccagtctccatcttccgtgtctgcatctgtaggagacagagtcaccatcacttgtcgggcgagtcaggatattaggcgctcgttaggctggtatcagcagaaagcagggaaacaccctaagctcctgatctatggtgcatccactttggaaagtggggtcccctcaaggttcagcggcagtggatctgggacagatttcactctcgccatcagcagcctgcagactgaagattttgcaacttattttgtcaacaggctaacactttcccctcactttcggcggagggaccaaggtggagatcaagcgaactgtggctgcaccatct

SEQ ID NO: 588326 - DNA, 502 bp, Homo sapiens; identical to SEQ ID NO: 543913
  misc_feature: HIJSMM301B2FBF.18.26.C04.1.454.light.4.raw

SEQ ID NO: 588327 - DNA, 488 bp, Homo sapiens; identical to SEQ ID NO: 541868
  misc_feature: HIJSMM301A9UI3.14.55.E11.1.454.light.4.raw

SEQ ID NO: 588328 - DNA, 487 bp, Homo sapiens; identical to SEQ ID NO: 575189
  misc_feature: HIJSMM301DQYZS.26.37.D04.1.454.light.4.raw

SEQ ID NO: 588329 - DNA, 485 bp, Homo sapiens
  misc_feature: HIJSMM301BEONW.49.73.G07.1.454.light.4.raw
agtcgagagacacgaccggtgctcgatttagctctacgctcagggcacgaccggtgctcgatttagcacacgatagttgggtttgggggatagaagttattcagcaggcacacaacagacccagtctccagactccctggctgtgtctctgggcgagagggccaccatcaactgcaggtccagcccagagtctttcacgcggcttcaataataagaactacttagcttggtaccagcaaaagccaggacagcctcctgaactgctcatttacctgggcatcttcccgggaatccggggtccctgagcgattcagtggcaggcgggtctgggacagatttcactctcaccatcagcagcctgcagactgaagatgtggcagtgtattactgtcagcaatatcacactgctccgctcactttcggcggagggaccagggtggagatcaaacgaactgtggctgcaccatctgcttcatccttcccgc

SEQ ID NO: 588330 - DNA, 448 bp, Homo sapiens
  misc_feature: HIJSMM301CF813.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgccagtcctatgacatgaggctgagtggttcgtatgtcttcggatctgggaccaaggtcaccgtcctaagtcagcccaaggccaacccctctgtcactctgtttcccaccctcctccatactcgta

SEQ ID NO: 588331 - DNA, 447 bp, Homo sapiens; identical to SEQ ID NO: 535020
  misc_feature: HIJSMM301D36FG.18.9.A09.1.454.light.4.raw

SEQ ID NO: 588332 - DNA, 483 bp, Homo sapiens
  misc_feature: HIJSMM301DIRN6.8.49.E05.1.454.light.4.raw
ctcgcgtgtccacgaccggtgctcgatttagagcgactagcaacacacaaagggggagtcagtctcagtcaggacacagcatggacatgagggtccccgctcagctcctggggctcctgctactctggctccgaggtggcagatgtgacatccagatgacccagtctccgccctccctgtctgcatctgtaggagacagagtcaccatcacttgccgggcaagtcagagcattggcacctacttaaattggtatcagcagaaaccagggaaagcccccaaactcctgatcaattatgcatccagtttgcaaagtgggtcccatcaagattcagtggcggtggatctgggacagatttcactctcaccatcaacagtctgcagattgaggattatgcaacttattactgtcagcagagttccaggaccccgctcactttcggcggggggaccaaagtggacgtcaaacgaactgtggctgcacc

SEQ ID NO: 588333 - DNA, 483 bp, Homo sapiens; identical to SEQ ID NO: 551190
  misc_feature: HIJSMM301B9OHH.4.74.G08.1.454.light.4.raw

SEQ ID NO: 588334 - DNA, 478 bp, Homo sapiens
  misc_feature: HIJSMM301BG1HX.22.6.A06.1.454.light.4.raw
acatacgcgtcacgaccggtgctcgatttagatctactgacagggggtgggtccaggaggcagaactctgggtgtctcaccatggcctggatccctctacttctccccctcctcactctctgcacagactctgaggccgcctatgagctgacacagccaccctcggtgtcagtgtccccaggacagacggccagaatcacctgctctggagatgcactgccaaatcaatatgcttttttggtatcaacagaggccaggccacgcccctgtcttaatgatatataaagacagtgagaggccctcagggatctctgagcgattctctgcctccagctcagggacaacattcacattgaccatcagtgaagtccaggcagaagatgaggctgactattattgtcaatcaacagacagtagtgggaaatatgtggtattcggcggagggaccaaactgaccgtcctaggtcagcccaaggct

SEQ ID NO: 588335 - DNA, 503 bp, Homo sapiens; identical to SEQ ID NO: 550542
  misc_feature: HIJSMM301D9KST.2.76.G10.1.454.light.4.raw

SEQ ID NO: 588336 - DNA, 492 bp, Homo sapiens; identical to SEQ ID NO: 566665
  misc_feature: HIJSMM301AE5EL.26.78.H01.1.454.light.4.raw

SEQ ID NO: 588337 - DNA, 472 bp, Homo sapiens; identical to SEQ ID NO: 565737
  misc_feature: HIJSMM301BMX5D.51.34.D01.1.454.light.4.raw

SEQ ID NO: 588338 - DNA, 486 bp, Homo sapiens; identical to SEQ ID NO: 565020
  misc_feature: HIJSMM301E04XQ.4.33.C11.1.454.light.4.raw

SEQ ID NO: 588339 - DNA, 504 bp, Homo sapiens
  misc_feature: HIJSMM301A78UE.27.78.H01.1.454.light.4.raw
  modified_base (495)..(495): a, c, t, g, unknown or other
agcgtcgtctcacgaccggtgctcgatttagtgtgagtagtttgggtttggggatcttaaaagaggttctttctctgggatgtggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactgganattaaaacg

SEQ ID NO: 588340 - DNA, 478 bp, Homo sapiens; identical to SEQ ID NO: 543315
  misc_feature: HIJSMM301EC0AP.26.72.G06.1.454.light.4.raw

SEQ ID NO: 588341 - DNA, 503 bp, Homo sapiens
  misc_feature: HIJSMM301DTHZT.21.38.D05.1.454.light.4.raw
tcgtcgctcgcacgaccggtgctcgatttagtatctgatagttgggtttggggagagctgctcagttaggacccagagggaaccatggaaaccccagcgcagcttctcttcctcctgctactctggctcccaggtgtcaccggagaagttgtcttgacgcagtctccaggcaccctgtctctgtctccaggggaaagagttactctctcctgcaaggccagtcagagtgttggcatcgacgttgcctggtaccaacaaaaacctggccaggctcccagtctcctcatctatggggcatcctacaggatgaccggcatcccagacaggttcagtgccagtgggtctgggacagacttcactctcaccatcaacacactggcgcctgaagattttgcagtgtattactgtcagatgtatggtaggtcaccgtacacctttggccaggggaccaaggtggagatcagacgaactgtggctgcaccatctgtcttcatctttccccg

SEQ ID NO: 588342 - DNA, 487 bp, Homo sapiens
  misc_feature: HIJSMM301CYPXC.7.85.H08.1.454.light.4.raw
cgtgtctctacacgaccggtgctcgatttagtatcactcagtcgcggggtccaaacagagcttcagcaaacatagtgggaatctgcaccatgccctgggctctgctcctcctgaccctcctcactcactctgcagtgtcagtggtccaggcagggctgactcagccaccctcggtgtccaaaggcctgcgacagaccgcaacactcacctgcactgggagcagcaacgatgttggcagggagggagcagcttggctgcagcaacacgagggccaccctcccaaactcctctcctacaggaataacgagcggccctcagggatctcagagagattctctgcatccaggtcaggaaacacagcctccctgaccattactggactccagcctgaggacgaggctgactattactgctcagcatgggacagcggcctcaggacttatgtcttcggaactgggacccacgttaccgtcctaggtcaagcccc

SEQ ID NO: 588343 - DNA, 503 bp, Homo sapiens
  misc_feature: HIJSMM301BIAE6.41.71.G05.1.454.light.4.raw
tctatactatcacgaccggtgctcgatttagtgtcgtcgcaagagagagggggagtcagacccagtcaggacacagcatggacatgagggtccccgctcagctcctggggctcctgctgctctggctcccaggtgccaaatgtgacatccagatgacccagtctccttccaccctgtctgcatctgtaggagacagagtcaccatcacttgccgggccagtcaggttattaataattggttggcctggtatcagcagaaaccagggaaagcccctaaactcctgatctataaggcgtctactttagagagtggggtcccttcaaggttcagtggcagtggatctgggacagagttcaccctcaccatcggcagcctgcagcctgaagatattcgcaacttattactgtcaacaatataacacttattcaggggcattcggccaagggaccaaggtggaaattaaacgaactagtggctgcaccatctgtcttcatcttcccgt

SEQ ID NO: 588344 - DNA, 488 bp, Homo sapiens; identical to SEQ ID NO: 537055
  misc_feature: HIJSMM301A8TEH.4.64.F09.1.454.light.4.raw

SEQ ID NO: 588345 - DNA, 502 bp, Homo sapiens
  misc_feature: HIJSMM301EA7YY.15.59.F04.1.454.light.4.raw
tctacgtagccacgaccggtgctcgatttagtacacacacttagggattgggaagcctgagaacacttagccttcatgagtgtccccaccatggcctggatgatgcttctcctcggactccttgcttatggatcaggagtggattctcagactgtggtgacccaggagccatcgttctcagtgtcccctggagggaccgtcacactcacttgtggcttgagctctggctcggtctctactccttactacccagctggtaccaacagaccccaggccagcctccacgcacgctcatctatagcacaaacactcgctcttctggggtccctgatcgcttctctggctccatccttggaaacaaagctgccctcaccatcacgggggcccaggcagatgatgaatctgtttattattgtgtcctatatatgggtgctggcatttcggtcttcggcggagggaccaagctgaccgtcctaggtcagcccaaggctgccccctcggt

SEQ ID NO: 588346 - DNA, 462 bp, Homo sapiens
  misc_feature: HIJSMM301ESV6K.49.6.A06.1.454.light.4.raw
agtcgagagacacgaccggtgctcgatttagatctactgacagggggagtcagtcccaaccaggacacagcatggacatgagggtccctgctcagctcctggggctcctgctgctctggctctcaggtgccagatgtatcatccagatgacccagtctccatcctccctgtctgcatctataggagacagaatcaccatcacttgccgggcgagtcaggacattagcatgtatctgaattggtatcagcaaaaaccagggacagcccctaagctcctgatcctcgatgcatccactttggaaacaggggtcccatcaaggttcagtggaagtggctctgggacagattttactttcaccatcagcagactgcagcctgaagatattgcaacatattactgtcaacagtatgatagtctcccgctcactttcggcggagggaccaaggtggagatcaaacgaa

SEQ ID NO: 588347 - DNA, 487 bp, Homo sapiens; identical to SEQ ID NO: 555619
  misc_feature: HIJSMM301BPRX2.46.35.D02.1.454.light.4.raw

SEQ ID NO: 588348 - DNA, 508 bp, Homo sapiens
  misc_feature: HIJSMM301A2WCU.48.15.B04.1.454.light.4.raw
agtatacatacacgaccggtgctcgatttagacagtatatatccgcgggggctacaacaggcaggcaggggcagcaagatggtgttgcagacccaggtcttcatttctctgttgctctggatctctggtgcctgcggggacatcgtgatgacccagtctccagactccctggctgtgtctctgggcgagacggccaccatcaactgcaagtccagccagagtgtttttcacacctccatgaacaaggagtacttggcttggttccagcagaaaccagggcagcctcctaaactactcatttactcggcatccacccggaagtccgaggttcctgaccgattccgtggcagcgggtctgggacagattttactctcaccatcactaccctgcaggctgaagatgtggcagtttattactgtcaacaatattattctactccgccgacgttcggccggggaccgaacgtggaaatacaaacgaactagtggctgcaccatctgtcttcat

SEQ ID NO: 588349 - DNA, 498 bp, Homo sapiens
  misc_feature: HIJSMM301AFY79.27.78.H01.1.454.light.4.raw
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttacctcaagtgatcaccttcggccaagggacacgactggagattaaacgtaactagtggctcgcaccatctcgtctt

SEQ ID NO: 588350 - DNA, 497 bp, Homo sapiens; identical to SEQ ID NO: 536371
  misc_feature: HIJSMM301AS9MW.16.78.H01.1.454.light.4.raw

SEQ ID NO: 588351 - DNA, 486 bp, Homo sapiens
  misc_feature: HIJSMM301E255I.16.81.H04.1.454.light.4.raw
  modified_base (449)..(449): a, c, t, g, unknown or other
tgtactactccacgaccggtgctcgatttagtagtgtagattcgcgggggagtcagactcagtcaggacacagcatggacatgagggtccccgctcagctcctggggctcctgctgctctggctcccaggtatcaaatgtgacatccagatgacccagtctccttccaccctgtctgcatctgtcggagacagagtcaccatcacttgccgggccagtcagagtgttggtacctggttggcctggtatcagcagaaaccagggaaagcccctaagctcctgatctatgatgtctccaatatggaaagtggggtcccatcaaggttcagcggcagtggatctgggacagaattcactctcaccatcagcagcctacagcctgatgattttgcgacttatattgcaacagtataagagtattcaactttcgcctcggacgaactagtgganatacaacgaaactagtaggctcgtcaccaactctgtt

SEQ ID NO: 588352 - DNA, 484 bp, Homo sapiens; identical to SEQ ID NO: 535400
  misc_feature: HIJSMM301DH38T.46.26.C04.1.454.light.4.raw

SEQ ID NO: 588353 - DNA, 510 bp, Homo sapiens
  misc_feature: HIJSMM301BBKTB.17.28.C06.1.454.light.4.raw
cgtagactagcacgaccggtgctcgatttagagctcacgtattgggtttggggcagcttcagctgtggtagagaagacaggattcaggacaatctccagcatggccggcttccctctcctcctcaccctcctcactcactgtgcagggtcctgggcccagtctgtgctgactcagccaccctcagtgtctgggacccccgggcagagggtcaccatatcttgttctggaaacagctccggcatctcaactaaacatttttgctggtaccagcaattcccaggatcggccccccgactcctcatctatagaaatgatcatcggccctccggggtccctgaccgattctctggctccatgtctggcacctcagcctccctgaccatcagtgggctccggtccgaggatgaggctgattattactgtgcaccgtgggatgacatcctgaatggtccggtgttcggcggagggaccaggctgaccgtcctaagtcagcccaaggctcgcccccc

SEQ ID NO: 588354 - DNA, 514 bp, Homo sapiens; identical to SEQ ID NO: 582482
  misc_feature: HIJSMM301D7N2D.9.14.B03.1.454.light.4.raw

SEQ ID NO: 588355 - DNA, 473 bp, Homo sapiens; identical to SEQ ID NO: 535262
  misc_feature: HIJSMM301ARFPO.8.67.G01.1.454.light.4.raw

SEQ ID NO: 588356 - DNA, 492 bp, Homo sapiens; identical to SEQ ID NO: 576371
  misc_feature: HIJSMM301B1OPS.43.33.C11.1.454.light.4.raw
  modified_base (361)..(361): a, c, t, g, unknown or other

SEQ ID NO: 588357 - DNA, 489 bp, Homo sapiens
  misc_feature: HIJSMM301A7ZPZ.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcacttcggcggagggaccgaaggcggagatcagacgaactgtggctgcaccatctgtcttcta

SEQ ID NO: 588358 - DNA, 501 bp, Homo sapiens; identical to SEQ ID NO: 546822
  misc_feature: HIJSMM301BB3VY.4.39.D06.1.454.light.4.raw

SEQ ID NO: 588359 - DNA, 495 bp, Homo sapiens; identical to SEQ ID NO: 544440
  misc_feature: HIJSMM301B59L1.16.6.A06.1.454.light.4.raw

SEQ ID NO: 588360 - DNA, 506 bp, Homo sapiens; identical to SEQ ID NO: 539303
  misc_feature: HIJSMM301DR1BC.8.19.B08.1.454.light.4.raw

SEQ ID NO: 588361 - DNA, 496 bp, Homo sapiens
  misc_feature: HIJSMM301BNKWN.40.57.F02.1.454.light.4.raw
tctagcgactcacgaccggtgctcgatttagctcgatatagttgggtttggggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggctccctgaccatctctgggctccagactgaggatgaggctacttattttgctgctcttatgcaggcagtttcgctctcgaagtgttcggcggagggaccgagctgaccgtcctacgtcagcccaaggctcg

SEQ ID NO: 588362 - DNA, 506 bp, Homo sapiens
  misc_feature: HIJSMM301AZAWV.8.71.G05.1.454.light.4.raw
ctcgcgtgtccacgaccggtgctcgatttagtgtcgtcgcaagagagaggggggagtcagtctcagtcaggacacagcatggacatgagggtccccgctcagctcctggggctcctgctcctctggctccgaggtgccagttgtgacatccagttgacccagtctccctcctctctgtctgcttctgtgggagacagcgtcaccatcacttgccgggcgagtcagtccattaacaactatttaaattggtatcaacaaaaaccagggaaagcccctaaatacctggtctatactgcatccactttgcaaagtggggtcccatcaaggttcagtggcagtggatttgggacagttttcactctcacaatcagcagtctcgaacctgaagattttgcaacttactactgtcaacagacttacaatataccgaggacgttcggtcaaggacgaaggtggagatcaaacgaaactgtggcgtgcaccatctgtcttcatcttcccgccat

SEQ ID NO: 588363 - DNA, 504 bp, Homo sapiens
  misc_feature: HIJSMM301A4IDG.48.37.D04.1.454.light.4.raw
agtatacatacacgaccggtgctcgatttagtagcatactgttgggtttgggggagctgctcagttaggacccagagggaaccatggaaaccccagcgcagcttctcttcctcctgctactctggctcccagatgcccccggagaaattgtgttgacgcagtctccagacaccctgtctttgtctccaggggaaagagccaccttctcctgcaggtccagtcagagtcttaccaacgactacttagcctggtaccatcagaaacctggccaggctcccaggctcctcatctacggtgcatccagcagggccactggcatcccagacaggttcagtggcagtgggtctgggacagacttcactctcaccgtcagcagactggaccctgaagattttgcagtgtattactgtcagcagtatggtagctcaccgatcaccttcggccaagggacacgactggagattaaccgaactgtggctgcaccatctgtcttcatcttccccg

SEQ ID NO: 588364 - DNA, 474 bp, Homo sapiens; identical to SEQ ID NO: 535264
  misc_feature: HIJSMM301AI1W5.13.76.G10.1.454.light.4.raw

SEQ ID NO: 588365 - DNA, 495 bp, Homo sapiens
  misc_feature: HIJSMM301EM3QJ.27.78.H01.1.454.light.4.raw
agcgtcgtctcacgaccggtgctcgatttagtgtgagtagtttgggtttgggggcatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatcgtgggacacatttcaccctcaccatcaatagcctggaagctgaagatgctgcaacttattactgtcatcagagtactactttacctcaagtgatcaccttcggccaagggacacgactggagattaaacggaactgtggctgcaccatctgt

SEQ ID NO: 588366 - DNA, 515 bp, Homo sapiens; identical to SEQ ID NO: 564475
  misc_feature: HIJSMM301ERS12.15.86.H09.1.454.light.4.raw

SEQ ID NO: 588367 - DNA, 505 bp, Homo sapiens
  misc_feature: HIJSMM301D1ZMN.48.83.H06.1.454.light.4.raw
agtatacatacacgaccggtgctcgatttagatcacgtgcgtcgcgggggggcctcaggaagcagcatcggaggtgcctcagccatggcatggatccctctcttcctcggcgtccttgcttactgcacaggttccgtggcctcctatgagctgactcagccaccctcagtgtccgtgtccccaggacagacagccagcatctcctgttttggacataaattgggggagaaatatgtttgttggtatcaacagaagccaggccagtcccctgtgttggtcatccgtgaagataacaagcggccctcaggcatccctgagcgattctctggctccaactctgggaacactgccaccctgaccatcagggggacccaggccttggatgaggctgactatcactgtcaggcgtgggacagcaacactgcgattttcggcggggggaccaggctgaccgtcggcggtcagcccaaggctgccccctcggtcactctgttcccaccctcct

SEQ ID NO: 588368 - DNA, 483 bp, Homo sapiens
  misc_feature: HIJSMM301ETCTB.7.67.G01.1.454.light.4.raw
cgtgtctctacacgaccggtgctcgatttagagtatacatattgggtttgggggctctgcttcagctgtgggcacaagaggcagcactcaggacaatctccagcatggcctggtctcctctcctcctcactctcctcgctcactgcacagggtcctgggcccagtctgtgctgacgcagccgccctcagtgtctggggccccagggcagagggtcaccatctcctgcactgggagcagctcccacagcggggcaggttctgatgttcactggtaccagcagcttccagggacagcccccaaactcctcatatacgagaacaccaatcggccctcaggagtccctgaccgattctctggctccaagtctggcacctcagcctccctggccatcactgggctccaggctgaggatgaggctgattattactgccagtcgtatgacagcagcctgagttgtttgggtgttcgggcggagggaaccg

SEQ ID NO: 588369 - DNA, 496 bp, Homo sapiens; identical to SEQ ID NO: 541772
  misc_feature: HIJSMM301AR2CK.51.81.H04.1.454.light.4.raw

SEQ ID NO: 588370 - DNA, 520 bp, Homo sapiens
  misc_feature: HIJSMM301BOTCA.22.30.C08.1.454.light.4.raw
acatacgcgtcacgaccggtgctcgatttagtctgacgtcaaagggaaaggggagagctctggggagtctgcaccatggcttggaccccactcctcttcctcaccctcctcctccactgcacagggtctctctcccaggttgtactgactcaatcgccctctgcctctgcctccctgggagcctcggtcaacctcacctgcgttcttagtagtcaacacgattactacaccgtcgcgtggcatcaacaacagccggagaagggccctcgctacttaatgaagattggccattttggcagccaccacaagggggtcgggatccctgatcgcttctcgggctccagctctggggccgagcgctacctcaccatctccagcctccagtctgaagatgaggctgactattactgtcagacatgggacgctggcgtctggctgttcggcggaggggaccaagctgaccgtcctaggtcagcccaaggctcgccccctcggtcactctgttcccaccctcctcacg

SEQ ID NO: 588371 - DNA, 444 bp, Homo sapiens; identical to SEQ ID NO: 535192
  misc_feature: HIJSMM301ERE8Q.5.9.A09.1.454.light.4.raw

SEQ ID NO: 588372 - DNA, 502 bp, Homo sapiens; identical to SEQ ID NO: 563496
  misc_feature: HIJSMM301EWDBD.40.28.C06.1.454.light.4.raw

SEQ ID NO: 588373 - DNA, 454 bp, Homo sapiens; identical to SEQ ID NO: 534964
  misc_feature: HIJSMM301EG5WL.19.86.H09.1.454.light.4.raw

SEQ ID NO: 588374 - DNA, 504 bp, Homo sapiens; identical to SEQ ID NO: 555616
  misc_feature: HIJSMM301DRU7M.5.86.H09.1.454.light.4.raw

SEQ ID NO: 588375 - DNA, 496 bp, Homo sapiens; identical to SEQ ID NO: 559491
  misc_feature: HIJSMM301CP5UP.18.59.F04.1.454.light.4.raw

SEQ ID NO: 588376 - DNA, 521 bp, Homo sapiens
  misc_feature: HIJSMM301ALA3G.5.58.F03.1.454.light.4.raw
atcagacacgcacgaccggtgctcgatttagtctgatcgagaagggaaaggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggggttataaccttgtctcctggtaccaacagcaaccaggcaaagcccccaaacttttggtttatcagggcaataagcggccctcaggggtttctaatcgcttctctggctccaagtctggcaacacggccgccctgacaatctctgggctccaggctgacgacgaggctgatttttactgctgctcatatgcaggtgatcactacttttatggttcgggactcgggaccaacggtcaccgtcctaggtcagcccaaggcccaaccccactgtcacttcttcccg

SEQ ID NO: 588377 - DNA, 504 bp, Homo sapiens; identical to SEQ ID NO: 549053
  misc_feature: HIJSMM301CCD4E.4.71.G05.1.454.light.4.raw

SEQ ID NO: 588378 - DNA, 494 bp, Homo sapiens; identical to SEQ ID NO: 534994
  misc_feature: HIJSMM301AX7GT.27.78.H01.1.454.light.4.raw

SEQ ID NO: 588379 - DNA, 498 bp, Homo sapiens
  misc_feature: HIJSMM301A1ELX.2.76.G10.1.454.light.4.raw
acgctcgacacacgaccggtgctcgatttagtcactcatacaggggggagagatctgggggaagctcagcttcagctgtggtagagaagacaggattcaggacagtctccagcatggccggcttccctctcctcctcaccctcctcactcactgtgcagggtcctgggcccagtctgtgctgactcagccaccctcagcgtctgggtcccccgggcagagggtcaccatctcttgttctggaggcacctccaacatcgggcgtgataatgtgtactggtacaagcaggtcccaggaacgacccccaaactcctcatctctcacaataatcagcggccctcaggagtccctgaccgattctctgcctccaagtccggcacctcagcctccctggccatcagtgggctccgggccgaggatgaggctgattattactgtgcaggatgggatgacaacctggtgcttatctcttcggacctgggaccaaggtcaccgtctt

SEQ ID NO: 588380 - DNA, 479 bp, Homo sapiens
  misc_feature: HIJSMM301B6Y58.51.76.G10.1.454.light.4.raw
cgatcgtatacacgaccggtgctcgatttagtcactcatacagggggaggaactgctcagttaggacccagacggaaccatggaagccccagcgcagcttctcttcctcctgctactctggctcccagataccactggagaagtagtgatgacgcagtctccagccaccctgtctgtgtctccaggggaaagagccaccctctcctgcagggccagtcagagtgttagcagcgacttagcctggtaccagcagaaacctggccaggctcccgggctcctcatctatgatgcatccacaagggccactgatatcccagccaggttcagtggcagtgggtctgggacagagttcactctcaccatcagcagcctgcagtctgaagatttgcaatttattactgtcagcagtataataactggcctccgtacacttttggccaggggaccaagctggagatcaaacgaactgtggctgcacc

SEQ ID NO: 588381 - DNA, 441 bp, Homo sapiens
  misc_feature: HIJSMM301AHSZB.18.9.A09.1.454.light.4.raw
tacgagtatgcacgaccggtgctcgatttagcgagacgcgcagggtcctgggcccagtctgtgctgacgcagccgccctcagtgtctggggccccagggcagagggtcaccatctcctgcactgggagcacctccaacatcggggcgggttatgatgtacactggtaccagcagcttccagggacagcccccaaactcctcatctttggtagcaacaatcggccctcaggggtccctgaccgattctctggctccaagtctggcacctcagcctccctggccatcactgggctccaggctgaggatgaggctgactattactgcagctcatatacaagcagcagcactcaagtcttcggaactgggaccaaggtcaccgtcctaggtcagcccaaggccaaccccactgtcactctgttcccaccctcctccatactcgta

SEQ ID NO: 588382 - DNA, 486 bp, Homo sapiens; identical to SEQ ID NO: 535385
  misc_feature: HIJSMM301EAETM.19.71.G05.1.454.light.4.raw

SEQ ID NO: 588383 - DNA, 507 bp, Homo sapiens
  misc_feature: HIJSMM301CBANL.21.22.B11.1.454.light.4.raw
tcgtcgctcgcacgaccggtgctcgatttagacgacagctcagggtggggtcaaaaacccggggaggggggtctgatttgcatggatggactctccccctctcagagtacgaagagagggagagatctggggggaagctcagcttcagctgtggtagagaagacaggactcaggacaatctccagcatggccggcttccctctcctcctcaccctcctcactcactgcgcagggtcctgggcccagtctgtgctgactcagccaccctcagcgtctgggacccccgggcagagggtcaccatctcttgttctggaggcaactccaacatcggaagtaattatgtattctggtatcagcaactcccaggaatggcccccaaactcctcatccagaggaataatcagcggccctcaggggtccctgaccgattctctggctccaagtctggcacctcagcctcctgaccatcagtgggctccggtccgaggatgaggctgactattact

SEQ ID NO: 588384 - DNA, 496 bp, Homo sapiens
  misc_feature: HIJSMM301DUG62.18.37.D04.1.454.light.4.raw
tacgagtatgcacgaccggtgctcgatttagtagcatactgttgggtttgggggactgatcaggactcctcagttcaccttctcacaatgaggctccctgctcagctcctggggctgctaatgctctgggtcccaggatccagtggggatgttgtgatgactcagtctccactctccctgcccgtcacccttggacagccggcctccatctcctgcaggtctagtccaagcctcgtatacagtgatggaaacaccttcttgaattggtttcagcaggggccaggccaatctccaaggcgcctaatttataaggtttccaaccgggactctggggtcccagacagattcagcggcagtgggtcaggcactgatttcacactggaaatcagcagggtggaggctgaggatgttggggtttattactgcatgacaaactacacaccggccgctctacgtttcggcggagggaccgaaggtggagatcaagaacaacgtg

SEQ ID NO: 588385 - DNA, 491 bp, Homo sapiens
  misc_feature: HIJSMM301B04MG.12.88.H11.1.454.light.4.raw
atacgacgtacacgaccggtgctcgatttagcgacagcgagaacacacaaaggggtgatcaggacttctcagttcatcttctcaccatgaggctccctgctcagctcctggggctgctaatgctctggatccctggatgcagtgcggatgttgtgatgacccagactccactctctctgtccgtcacccctggacagccggcctccatctcctgcaagtctagtcggagcctcctccatagtgatggaaagacctatttgtattggtacctgcagaaggcaggccagtctccacacctcctaatctatgaggtttccagccggttctctggagtgccagaaaggttcagtggcagcgggtcaggggacagatttcacactgaaaatcagccgggtgggggcgtgaggatgttggcatttattactgcatgcaggctatacaccttcctgccacttttggccaggggaccaagctggagatcaggcgtaacg

SEQ ID NO: 588386 - DNA, 510 bp, Homo sapiens
  misc_feature: HIJSMM301EN88F.43.67.G01.1.454.light.4.raw
tgtgagtagtcacgaccggtgctcgatttagagtatacatattgggtttgggggctacaacaggcaggcaggggcagcaagatggtgttgcagacccaggtcttcatttctctgttgctctggatctctggtgcctgcggggacatcgtgatgatccagtctccagagtccctggctgtgtctctgggcgagacggccaccatcaactgcaagtccagccagagtgttttatatagccccaggaacaaggactacctggcttggttccagcacaaaccagggcagcctccaaagctgctcatttacttgggatctacccgggaatccggggtccctgaccgattccgtggcagcgggtctgggacagacttcactctcaccatcagtagcctgcagcctgaagatgtggcaacttattactgtcaacaatttcgttatactccgccgacgttcggccggggaccgaccgtggaaatcaaacgaactcgtggctgcaccatctgtcttcta

SEQ ID NO: 588387 - DNA, 444 bp, Homo sapiens; identical to SEQ ID NO: 535027
  misc_feature: HIJSMM301AO1H3.8.73.G07.1.454.light.4.raw

SEQ ID NO: 588388 - DNA, 479 bp, Homo sapiens; identical to SEQ ID NO: 543959
  misc_feature: HIJSMM301BQXSK.11.11.A11.1.454.light.4.raw

SEQ ID NO: 588389 - DNA, 499 bp, Homo sapiens
  misc_feature: HIJSMM301DVDW2.22.27.C05.1.454.light.4.raw
acatacgcgtcacgaccggtgctcgatttagacgcgatcgaagggtttgggggagctacaacaggcaggcaggggcagcaagatggtgttgcagacccaggtcttcatttctctgttgctctggatctctggtgcctccggggacatcgtgatgacccagtctccagactccctggctgtgtctctgggcgagagggccaccatcaactgcaagtccagccagagtattttttacagctccaccaataagagctacttagcttggttccagcagaaaccaggacatcctcctctactgctcatttactgggcgtctacccgggaatccggggtccctgaccgattcagtggcagcgggtctgggacagatttcactctcaccatcagcagcctgcaggctgaagatgtggcagtttattactgtcagcaatattatattcctcctcagacgttcggccaagggaccaaggtggaaatcaaaacgaactgtggctgcacc

SEQ ID NO: 588390 - DNA, 489 bp, Homo sapiens; identical to SEQ ID NO: 587839
  misc_feature: HIJSMM301A0IQU.43.36.D03.1.454.light.4.raw

SEQ ID NO: 588391 - DNA, 496 bp, Homo sapiens; identical to SEQ ID NO: 536802
  misc_feature: HIJSMM301EG6RX.5.24.C02.1.454.light.4.raw

SEQ ID NO: 588392 - DNA, 508 bp, Homo sapiens
  misc_feature: HIJSMM301D4TVS.52.77.G11.1.454.light.4.raw
cgcagtacgacacgaccggtgctcgatttagctagtcactcaagggaaagggggcttcagggcagttggtagatgcccctctgggagagatccccaggggtgacagccatggaccctggaagggcctgggctagggacagggaccagagccagtccagggagaggacagagccaatggactggggtgtactgtaacagccctgctggcgagagggaccagggcaccgtcctccagggagcccatgctgcaagtcgggccagaggtgcccctgaacctgaaggccaatgagacccaagacaggccaagtgggttgtgagacccctgaggagctgggccctggtcccaggcagtgctggcccctgctgctgctgggtctggccatggtcgcccatggcctgctgcgcccaatgttgcaccgcaaagcggggacccagaccctggagcctcagttggaagcagccgatccagcctgcggagcctgtgggcaggtcagcccaaggccaaccc

SEQ ID NO: 588393 - DNA, 504 bp, Homo sapiens; identical to SEQ ID NO: 538940
  misc_feature: HIJSMM301DYRY9.2.35.D02.1.454.light.4.raw

SEQ ID NO: 588394 - DNA, 479 bp, Homo sapiens
  misc_feature: HIJSMM301CLU5N.46.26.C04.1.454.light.4.raw
actagcagtacacgaccggtgctcgatttagtctagcgactttgggtttggggtgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagtaatggagacaactatttggattggtacctgcagaagccagggcagtctccacagctcatcatctatttgggttctaatcgggcctccggggtccctgacaggttcagtggcagtggatcatgcacagattttacactgaaaatcagcagagtggaggctgaggatgttgggctctattattgtcatgcaagctctacaagtcccgctcactttcggcggagggaccgaagtaggagagt

SEQ ID NO: 588395 - DNA, 502 bp, Homo sapiens; identical to SEQ ID NO: 536253
  misc_feature: HIJSMM301A32GJ.21.22.B11.1.454.light.4.raw

SEQ ID NO: 588396 - DNA, 485 bp, Homo sapiens
  misc_feature: HIJSMM301AR5MJ.13.56.F01.1.454.light.4.raw
tcacgtactacacgaccggtgctcgatttagcagacgtctgaacacacaaaggggagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaagagccaccctctcctgcagggccagtcagacagttagcaacaacgtagcctggtaccagcagaaacgtggccaggctcccaggctcctcatctatggtgcatccaccagggccactggtatcccagaccggttcagtggcagtgggtctgggacagacttcactctcaccatcagcagtctgcagtctgagattttgcagtttattactgtcagcagtataataactggcctccgtacatgtacacttttggccaggggaccaaccgtggagat

SEQ ID NO: 588397 - DNA, 501 bp, Homo sapiens
  misc_feature: HIJSMM301CPN2Q.9.81.H04.1.454.light.4.raw
tgatacgtctcacgaccggtgctcgatttagtagtgtagattcgcggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcggtcaccatctcctgcactggaaccagcagtgacattggtgcttataactatgtctcctggtaccaacagcacccaggcaaagtccccaaactcatgatttatgaggtcaataagcggccctctggggtccctgatcgcttctctggctccaagtctggcaacacggcctccctgaccgtctctgggctccaggctgacgatgaggctgattattactgcagctcatatgcaggcacccacaatgtcttcggaagtgggaccacggtcaccgtcctaggtcagcccaaggccaaccccactgcactc

SEQ ID NO: 588398 - DNA, 484 bp, Homo sapiens; identical to SEQ ID NO: 535400
  misc_feature: HIJSMM301BDE6S.46.26.C04.1.454.light.4.raw

SEQ ID NO: 588399 - DNA, 487 bp, Homo sapiens; identical to SEQ ID NO: 536536
  misc_feature: HIJSMM301D23US.26.45.E01.1.454.light.4.raw

SEQ ID NO: 588400 - DNA, 499 bp, Homo sapiens
  misc_feature: HIJSMM301B38T2.53.81.H04.1.454.light.4.raw
cgcgtatacacacgaccggtgctcgatttagtagtgtagattcgcggggagcttcagctgtggtagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcctgttctggaagcaggtccaacatcggaagtgattttgtattctggtaccagctgctcccaggagcgggccccaaactcctcatttacaggaatgatcagcggccctcaggggtccctgaccgattctctggctccaagtctggcacctcagcctccctggccatcagtggcctccggtccgacgatgaggctgattattattgtgcagcatgggatgacagcctgagtggtgtggtattcggcggagggaccaagctgaccgtcctaggtcagcccaaggctcg

SEQ ID NO: 588401 - DNA, 503 bp, Homo sapiens
  misc_feature: HIJSMM301AZJUA.41.18.B07.1.454.light.4.raw
tctatactatcacgaccggtgctcgatttagtcgctgcgtaagggggtgggtccaggaggcagaactctgggtgtctcaccatggcctggatccctctacttctccccctcctcactctctgcacaggctctgaggccgcctatgaggtgacacagccacactcggtgtcagtgtccccaggacagacggccaggatcacctgctctggagatgaattgccaaggcaatttgtttattggtaccagcagaagccagcccaggcccctgtgttggtgatgtataaagacagtgagaggccctcagggatccctgagcgattctctggcgccagctcaggaacagtagtcacgttgaccatcagtggagtccaggcagaagacgaggctgactattattgtcaagcagtagacagcagtggtccttatcgggtgttcggcgggggaccaagctgaccgtcctaggtcagcccaaggctcgccccctccggtcactctgttccccg

SEQ ID NO: 588402 - DNA, 507 bp, Homo sapiens; identical to SEQ ID NO: 563344
  misc_feature: HIJSMM301CZXJM.3.79.H02.1.454.light.4.raw

SEQ ID NO: 588403 - DNA, 491 bp, Homo sapiens; identical to SEQ ID NO: 535294
  misc_feature: HIJSMM301E37S8.16.68.G02.1.454.light.4.raw

SEQ ID NO: 588404 - DNA, 497 bp, Homo sapiens
  misc_feature: HIJSMM301D2B0C.9.1.A01.1.454.light.4.raw
tgatacgtctcacgaccggtgctcgatttagacgtctcatcagggggagctgctcagttaggacccagagggaaccatggaaaccccagcgcagcttctcttcctcctgctactctggctcccagataccaccggagaaattgtgttgacgcagtctccgggcaccctgtctttctctccaggggagagagccaccctctcctgcaggaccagtcagagtgttaccagcaactacttggcctggtaccagcagaaatctggccagcctcccaggctcctcatctatggtgaatccaacagggccactggcatcccagacaggttcagtggcagtgggtctgggacagacttcactctcaccatcagcagactggagcctgaggattttgcagtgtattactgtcagcagtatcataggtcaaacaccttcggccaagggacacggactggagattaaaaggaactagtggctgcaccatctgtcttcatcttccccg

SEQ ID NO: 588405 - DNA, 495 bp, Homo sapiens
  misc_feature: HIJSMM301EEOBN.14.55.E11.1.454.light.4.raw
  modified_base (430)..(430): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctcgatctatgctgcatccagtttgcacagtggggtcccgtcaaggttcagtggcagtggatctgggacagatttcactctcaccgtcagcagtctgcaacctgaagattttgcaacttactactgtctaacagagtttacagtacccccctnactttcggcggtagggaccaaggtcggagatcagacgaactgtggctgcaccatctcgtcttcta

SEQ ID NO: 588406 - DNA, 482 bp, Homo sapiens; identical to SEQ ID NO: 550464
  misc_feature: HIJSMM301D56S0.13.50.E06.1.454.light.4.raw

SEQ ID NO: 588407 - DNA, 504 bp, Homo sapiens; identical to SEQ ID NO: 535935
  misc_feature: HIJSMM301CRN7D.18.78.H01.1.454.light.4.raw

SEQ ID NO: 588408 - DNA, 522 bp, Homo sapiens
  misc_feature: HIJSMM301CPWAI.13.53.E09.1.454.light.4.raw
tcacgtactacacgaccggtgctcgatttagagagagtgtgttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagattttaccctcaccatcaggggtctacagcctgaagattttgcgacttactattgtcaacagagttaccttctcccccggacgttcggtccaaggaccaacggtaggaaagtacaagacgaacgtacggtaggcgtcgcgaccaactctcgtcgttctacttcttcccgt

SEQ ID NO: 588409 - DNA, 500 bp, Homo sapiens
  misc_feature: HIJSMM301BHX0D.8.19.B08.1.454.light.4.raw
ctcgcgtgtccacgaccggtgctcgatttagtgagtcagtaagggggaggaactgctcagttaggacccagagggaaccatggaagccccagctcagcttctcttcctcctgctactctggctcccaggtaccaccggagagattgtgttgacgcagtcgccagccaccctgtctttgtctccaggggacagagtcaccctctcctgtagggccagttatggtgttggcggctacttagcctggtaccaacaaaaacgtggccaggctcccaggctcctcatctatgaagcatccaccagggccactggcatcccagccaggttcaatggcagtgggtctgggacagacttcactctcaccatcagcagcctggagcctgaagatattgcagtttattactgtcagcagcgtagcaactggcctttcactttcggcccggggaccaaagtggaaatcaaacgaactgtggctgcaccatctgtcttcatcttcccgccat

SEQ ID NO: 588410 - DNA, 441 bp, Homo sapiens; identical to SEQ ID NO: 534971
  misc_feature: HIJSMM301BLOD8.11.3.A03.1.454.light.4.raw

SEQ ID NO: 588411 - DNA, 483 bp, Homo sapiens
  misc_feature: HIJSMM301AWNIK.52.5.A05.1.454.light.4.raw
cgcagtacgacacgaccggtgctcgatttagatagatagacagggggcctgggcctcaggaagcagcatcggaggtgcctcagccatggcatggatccctctcttcctcggcgtccttgcttactgcacaggttctgtggcctcctatgacttgactcagccaccctcagtgtccgtgtccccaggacagacagccaccatcacctgctctggacatcgattgggggatatacatgtttcctggtatcagcagaagccaggccagtctcctgttctcctcatctataaagatgtcaagcggccctcagggatccctgagcgattctctggctccaattctggaaatgcagccactctgaccatcagcgggacccagcctatggatgaggctgactattactgtcaggcgtgggacagtaggtttgtgcttttcggcggagggaccaagctgaccgtcctacgtcagcccaaggctgccccctc

SEQ ID NO: 588412 - DNA, 491 bp, Homo sapiens; identical to SEQ ID NO: 535294
  misc_feature: HIJSMM301D8LBC.16.68.G02.1.454.light.4.raw

SEQ ID NO: 588413 - DNA, 502 bp, Homo sapiens; identical to SEQ ID NO: 541501
  misc_feature: HIJSMM301CPUMV.17.27.C05.1.454.light.4.raw

SEQ ID NO: 588414 - DNA, 499 bp, Homo sapiens
  misc_feature: HIJSMM301BWAXL.22.38.D05.1.454.light.4.raw
acatacgcgtcacgaccggtgctcgatttagtatctgatagttgggtttgggggaggaactgctcagttaggacccagagggaaccatggaagccccagctcagcttctcttcctcctgctactctggctcccagataccaccggagaaattgtgttgacacagtctccagccaccctgtctttgtctccgggggaaagagccaccctctcctgcagggccagtcagaatgttagtagttacttagcctggtaccagcaaaagcctggccaggctcccagactcctcatctctgatacatccaacagggccactggcatcccagccaggttcagtggcagtgggtctgggacagacttcactctcaccatcagcgacctagagcctgaagattttgcagtttattactgtcagcagcgtagcatctggcctccgtacacctttggccaggggaccaagctggagatcaaacgactgtggctgcaccatctgtcttcatt

SEQ ID NO: 588415 - DNA, 491 bp, Homo sapiens
  misc_feature: HIJSMM301EFRON.14.55.E11.1.454.light.4.raw
  modified_base (430)..(430): a, c, t, g, unknown or other
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagtattttgcaaactttactactgtcaacagagttacagtacccccctnactttcggcggagggaccaaggcggagatcagacgaactgtgctgcaccatctgtcttcta

SEQ ID NO: 588416 - DNA, 486 bp, Homo sapiens
  misc_feature: HIJSMM301E3OK4.49.81.H04.1.454.light.4.raw
agtcgagagacacgaccggtgctcgatttagtagtgtagattcgcggggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttctaccatcatcaacctgcagcctgaggatattgcaacatattactgtcaacaatatgataatctaccactcactttcgtggtagggaccgacggtggaggatcaaacgaactagtggctgcaccat

SEQ ID NO: 588417 - DNA, 486 bp, Homo sapiens; identical to SEQ ID NO: 535043
  misc_feature: HIJSMM301CT3HE.46.35.D02.1.454.light.4.raw

SEQ ID NO: 588418 - DNA, 493 bp, Homo sapiens; identical to SEQ ID NO: 535770
  misc_feature: HIJSMM301EAMPJ.51.71.G05.1.454.light.4.raw

SEQ ID NO: 588419 - DNA, 497 bp, Homo sapiens
  misc_feature: HIJSMM301ARZ7C.40.37.D04.1.454.light.4.raw
tctagcgactcacgaccggtgctcgatttagtagcatactgttgggtttggggtgatcaggacttctcagttcatcttctcaccatgaggctccctgctcagctcctggggctgctaatgctctggatccctggttccagtgcgagggttgtgatgactcagactccactctctctgtccgtcacccctggacagccggcctccatctcctgcaagtctgctcagagcctcctgcatggtgatggaatcacctatttatattggtacctgcagaagccaggccagtctccacagctcctaatctatgaggtttccagccggttctctggatgccagataggttcagtggcagcggtcagtgacagatttcacactgaaaatcagccggtggaggctgaggatgttgggttattactgcatgctaaggttataccttcctcggtactttcggcccgtcggaccgacgtaggtaggtagtagtcgtaaacgtaacgtac

SEQ ID NO: 588420 - DNA, 444 bp, Homo sapiens; identical to SEQ ID NO: 535411
  misc_feature: HIJSMM301EKZZY.8.73.G07.1.454.light.4.raw

SEQ ID NO: 588421 - DNA, 502 bp, Homo sapiens
  misc_feature: HIJSMM301DEYML.43.34.D01.1.454.light.4.raw
tgtgagtagtcacgaccggtgctcgatttagatcgtctgtgttgggtttggggggggtcacaagaggcagcgctctcgggacgtctccaccatggcctgggctctgctgctcctcactctcctcgctcaggacacagggtcctgggcccagtctgccctgactcagcctgcctccgtgtctgggtctcctggacagtcgatcaccatctcctgcactggaaccagcagtgatgttgggagttatagccttgtctcctggtaccaagtgcacccaggcaaagcccccaaactcatgatttatgagggcactaagcggccctcaggggtttctgatcgcttctctggctccaagtctggcaacacggcctccctgacaatctctgggctccaggctgaggacgaggctgattattattgctgctcatatgcaggtagttacacttatgtcttcggaattgggacgacggtcaccgtcctaggtcagcccaaggcccaaccccac

SEQ ID NO: 588422 - DNA, 506 bp, Homo sapiens
  misc_feature: HIJSMM301C1D6L.4.10.A10.1.454.light.4.raw
agcactgtagcacgaccggtgctcgatttagcgtcgatctcagggggggtagagaagacaggactcaggacaatctccagcatggccagcttccctctcctcctcaccctcctcactcactgtgcagggtcctgggcccactctgtgctgactcagccaccctcagcgtctgggacccccgggcagagggtcaccatctcttgttctggaagcacctccaacatcggaagtaatcctgtaaactggttccagcaactcccaggaagggcccccaaagtcctcatctatggtcagaatcagcgtccctcaggggtccctgaccgattctctggctccaagtctgacacctcagcctccctggccatcagtgggctccagtctgaggatgaggctgattattactgtgcaacatgggatgacatcctacgtggtgcggtgttcggcggagggaccaagttgacgtcctgggtcagcccaaggctgccccctcggtcactctgttccca

SEQ ID NO: 588423 - DNA, 508 bp, Homo sapiens
  misc_feature: HIJSMM301D996V.11.57.F02.1.454.light.4.raw
  modified_base (476)..(476): a, c, t, g, unknown or other
cgagagataccacgaccggtgctcgatttagctcgatatagttgggtttgggggaggaactgctcagttaggacccagagggaaccatggaagccccagctcagcttctcttcctcctgctactctggctcccagataccaccggagaaattgtgttgacacagtctccggccaccctgtctgcgtctcctggggaaacagtcaccctctcctgcagggccagtcaaaatattaacaactacttagcctggttccaacagaaacctggccaggctcccaggctcctcatctatgatgcatttaggagggccactggcatcccacccaggttcagtggcagtgggtctgggacagacttcattctcaccatccgcagcctagagcctgaagattttgcagtttattactgtcaacagcgtagcagcaggcctccggcgacgttcggcaagggaccaaggtggagtcaagcgaactgnggctgcaccatctgtcttcatcttcccgccat

SEQ ID NO: 588424 - DNA, 495 bp, Homo sapiens
  misc_feature: HIJSMM301DP689.27.78.H01.1.454.light.4.raw
  modified_base (426)..(426): a, c, t, g, unknown or other
  modified_base (462)..(462): a, c, t, g, unknown or other
agcgtcgtctcacgaccggtgctcgatttagtgtgagtagtttgggtttggggatgagcaaaactgacaagtcaaggcaggaagatgttgccatcacaactcattgggtttctgctgctctgggttccagcctccaggggtgaaattgtgctgactcagtctccagactttcagtctgtgactccaaaggagaaagtcaccatcacctgccgggccagtcagagcgttggtagtagcttacactggtaccagcagaagccaggtcagtctccaaagctcctcatcaagtatgcttcccagtccttctcaggggtcccctcgaggttcagtggcagtggatctgggacacatttcaccctcaccatcaatagcctggaagctgaagatgctgcaacttattactgtcatcagagtactactttaccncaagtgatcaccttcggccaagggacacgactgganattaaacgaacgtgtggctgcaccatctgtctt

SEQ ID NO: 588425 - DNA, 497 bp, Homo sapiens; identical to SEQ ID NO: 535740
  misc_feature: HIJSMM301BRF01.3.71.G05.1.454.light.4.raw

SEQ ID NO: 588426 - DNA, 508 bp, Homo sapiens; identical to SEQ ID NO: 545298
  misc_feature: HIJSMM301AF8AW.8.42.D09.1.454.light.4.raw

SEQ ID NO: 588427 - DNA, 514 bp, Homo sapiens
  misc_feature: HIJSMM301EBP0H.14.19.B08.1.454.light.4.raw
cgtctagtaccacgaccggtgctcgatttagtgagtcagtaaggggagagaagacaggattcaggacaatctccagcatggccggcttccctctcctcctcaccctcctcactcactgtgcagggtcctgggcccagtctgtgctgactcagccaccctcagcgtctgggacccccgggcagagggtcaccatctcttgttctggaagcagctccaaaatcggaagtcgttatgtatactggttccagcagctcccaggaacggcccccaaactcctcatctataggaataatcagcggccctcaggggtccctgaccgattctctggctccaaggctggcacctcagcctccctggccatcagtgggctccggtccgaggatgaggctgattattactgtgcagcatgggatgacagcctgagtggtccttgggtgttcggcggagggaccaagctgaccgtctaagtcagcccaaggctgccccctcggtcactctgttcccaccctcctcg

SEQ ID NO: 588428 - DNA, 498 bp, Homo sapiens; identical to SEQ ID NO: 578989
  misc_feature: HIJSMM301C76ME.43.34.D01.1.454.light.4.raw

SEQ ID NO: 588429 - DNA, 486 bp, Homo sapiens; identical to SEQ ID NO: 535043
  misc_feature: HIJSMM301AUG9V.46.35.D02.1.454.light.4.raw

SEQ ID NO: 588430 - DNA, 493 bp, Homo sapiens
  misc_feature: HIJSMM301AS1OT.40.83.H06.1.454.light.4.raw
tctagcgactcacgaccggtgctcgatttagatcacgtgcgtcgcggggctccaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagtctgaggacgaggctgactattactgttcagcatgggacggcagcctcagtgaatgggtgttcgggcggaggggacccaaagtcgtcgtcccgtacggtacgtacg

SEQ ID NO: 588431 - DNA, 503 bp, Homo sapiens
  misc_feature: HIJSMM301AOPHH.49.68.G02.1.454.light.4.raw
agtcgagagacacgaccggtgctcgatttagtcgatagtgaagggaaagggggaggaactgctcagttaggacccagagggaaccatggaagccccagctcagcttctcttcctcctgcttctctggctcccagatattaccggagaaattgtgttgacgcagtctccagccaccctgtctttgtctccaggggaaagagccaccctctcctgcagggccagtcagagtgttaacatctacttagtctggtaccaacagaaagctggccacgctcccaggctcctcatctatgatacatccaccagggcccctggcatcccagccaggttcagtggcagtgggtctgggacagacttcactctcaccatcagcagcttagagcctgaagattttgcagtttattactgtcagcagcgtatcaccgggatcaccttcggccaagggacccgactggagattaagcgaactgtggctgcaccatctgtcttcatcttcccgccta

SEQ ID NO: 588432 - DNA, 496 bp, Homo sapiens
  misc_feature: HIJSMM301C7WUQ.12.37.D04.1.454.light.4.raw
atacgacgtacacgaccggtgctcgatttagtagcatactgttgggtttgggggcaggagtcagtcccaacctggacacagcatggacatgagggtccctgctcagctcctggggctcctgctgctctggctcccaggtgccagatgtgacatccagatgacccagtctccatcctccctgtctgcttctgtcggagacagagtcaccatcacttgccaggcgagtgaggacattcggaaatttttaaattggtttcagcagaaaccagggaaagcccctagactcctgattcacgaggcatccaattcggaaataggggtcccacgaaggttcagtggaggtggagctgggacagattttaccctcaccatcagcagcctgcagcctgaagatcttgcaacatattactgtcaacagtataataatctccgtacacttttggccagggaccaagctggagatcaaacgaactgtggctgcaccatctgtcttcta

SEQ ID NO: 588433 - DNA, 490 bp, Homo sapiens
  misc_feature: HIJSMM301CC8MA.47.48.E04.1.454.light.4.raw
agctcacgtacacgaccggtgctcgatttagagagcgtcacagagagaagggggaatcagtcccactcaggacacagcatggacatgagggtccccgctcagctcctggggctcctgctgctctggttcccaggtgccaggtgtgacatccagatgacccagtctccatcctccctgtctgcatctgtaggagacagagtcaccatcacttgccgggcgagtcagggcgttgcaaatgctttggcctggtttcagcagacaccagggaaggcccctaagcgcctgatctatggtgcatacactttgcaaagtggggtcccatcaaggttcagcggcagtaggtctgggacagagttcactctcactatcagcggcctgcagcctgaagattctgcaacttattactgtctccagtatgatgcttaccctcggactttcggtccaacgggaccgaacggtggaaatacaaacgaaactgtggctgcaccta

SEQ ID NO: 588434 - DNA, 501 bp, Homo sapiens; identical to SEQ ID NO: 584098
  misc_feature: HIJSMM301EJ8VX.4.39.D06.1.454.light.4.raw

SEQ ID NO: 588435 - DNA, 493 bp, Homo sapiens; identical to SEQ ID NO: 536769
  misc_feature: HIJSMM301A8JBR.19.83.H06.1.454.light.4.raw

SEQ ID NO: 588436 - DNA, 509 bp, Homo sapiens; identical to SEQ ID NO: 553073
  misc_feature: HIJSMM301D9RWG.16.1.A01.1.454.light.4.raw

SEQ ID NO: 588437 - DNA, 518 bp, Homo sapiens
  misc_feature: HIJSMM301BA32Y.51.30.C08.1.454.light.4.raw
  modified_base (507)..(507): a, c, t, g, unknown or other
cgatcgtatacacgaccggtgctcgatttagtctgacgtcaaagggaaagggggtgggctcaggaggcagagctctgggaatctcaccatggcctggacccctctcctgctccccctcctcactttctgcacagtctctgaggcctcctatgagctgacacagtcaccctcgctgtcagtgtccccaggacaaacggccaggatcacctgctctggagatgcattgccaaaaagatatgcttattggtaccatcagaagtcaggccaggcccctgtactggtcatctatgaggacaccaaacgaccctccgggatccctacgagattctctggctccagtttagggacagtggccaccctgacaatcagtggggcccaggtggggatgagggtgattactactgttactcaacagacattactactactcatagggtgttcggcggagggaccaagctgaccgtcctaggtcagcccaaggctgccccctcggtcactctgttcccnccctcctctcg

SEQ ID NO: 588438 - DNA, 494 bp, Homo sapiens; identical to SEQ ID NO: 535680
  misc_feature: HIJSMM301A46GL.16.78.H01.1.454.light.4.raw

SEQ ID NO: 588439 - DNA, 500 bp, Homo sapiens
  misc_feature: HIJSMM301C2C4R.48.73.G07.1.454.light.4.raw
agtatacatacacgaccggtgctcgatttagctctacgctcagggcacgaccggtgctcgatttagtagcatactgttgggtttgggggtgggctcaggaggcagagctctgggaatctcaccatggcctggacccctctcctgctccccctcctcactttctgcacagtctctgaggcctcctatgagctgacacagccaccctcggtgtcagtgtccccaggacaaacggccaggatcacctgctctggagatgcattgccaaaaaaatatgcttattggtaccagcagaagtcaggccaggcccctgtgctggtcatctttgaggacaacaaacgaccctccgggatccctgagagattctctggctccagctcagggacaatggccaccttgactatcaatggggcccaggtggacgatgaggctgactactactgttcctcaacagacagtagtggtgatcgagggctgttcggcggagggaccaagctgacccg

SEQ ID NO: 588440 - DNA, 503 bp, Homo sapiens; identical to SEQ ID NO: 535331
  misc_feature: HIJSMM301EAPJ7.48.34.D01.1.454.light.4.raw

SEQ ID NO: 588441 - DNA, 514 bp, Homo sapiens
  misc_feature: HIJSMM301A8V1Q.48.81.H04.1.454.light.4.raw
agtatacatacacgaccggtgctcgatttagtagtgtagattcgcggggctgcttcagctgtgagcgcagaaggcaggactcgggacaatcttcatcatgacctgctcccctctcctcctcacccttctcattcactgcacagggtcctgggcccagtctgtgttgacgcagccgccctcagtgtctgcggccccaggacagaaggtaaccatctcctgctctggaagtagttccaacattgggaataattatgtctcctggtatcagcaactcccaggaacagcccccaaactcctcatttatgacaataataagcgaccctcaggaattcctgaccgattctctggctccaagtctggcacgtcagccaccctgggcatcaccggactccagactggggacgaggccgattattactgcggaacatgggataacagcccgagtggtggccgggtcttcggcggagggaccaagctgaccgtcctacgtcagcccaaggctcgccccctcggt

SEQ ID NO: 588442 - DNA, 493 bp, Homo sapiens
  misc_feature: HIJSMM301BBATL.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccgatacaactgcaaagtccagccacaatcttttatacagttccaacaatgaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacggtttcgccgaagggaccaaggtaggataatcagaccgaa

SEQ ID NO: 588443 - DNA, 486 bp, Homo sapiens; identical to SEQ ID NO: 535458
  misc_feature: HIJSMM301APTXJ.7.75.G09.1.454.light.4.raw

SEQ ID NO: 588444 - DNA, 489 bp, Homo sapiens; identical to SEQ ID NO: 535139
  misc_feature: HIJSMM301CRYJZ.14.55.E11.1.454.light.4.raw

SEQ ID NO: 588445 - DNA, 494 bp, Homo sapiens; identical to SEQ ID NO: 535680
  misc_feature: HIJSMM301DILVW.16.78.H01.1.454.light.4.raw

SEQ ID NO: 588446 - DNA, 501 bp, Homo sapiens
  misc_feature: HIJSMM301DDMKS.18.26.C04.1.454.light.4.raw
tacgagtatgcacgaccggtgctcgatttagtctagcgactttgggtttggggggtcagacccagtcgggacacagcatggacatgagggtccccgctcagctcctggggctcctgctgctctggttcccaggttccagatgcgacatccagatgacccagtctccatcttccgtggctgcctctgtaggagacagagtcagcatcacttgtcggacgagtcaacatattagctggttaatttggtatcagcagaaagcaggaaaagcccctaacctcctgatcaagggtccgtccagtttccagagtggggcctcaacaaggttcagcggcagtggatctgggacagatttcactctcaccatcaccagcctgcagcctgaagattttgcaacttactattgtcaacaggctgacaggttcccgctgactttcggcggagggaccaaggtggagatcaaacgaactgtggctgcaccatctgtcttcatcttcccgccta

SEQ ID NO: 588447 - DNA, 488 bp, Homo sapiens
  misc_feature: HIJSMM301A1Z7T.26.45.E01.1.454.light.4.raw
agactatactcacgaccggtgctcgatttagtgagtcagtaagggaaaggggtgatcaggactcctcagttcaccttctcacaatgaggctccctgctcagctcctggggctgctaatgctctgggtctctggatccagtggagatattgtgatggctcagtctccactctccctgcccgtcacccctggagagccggcctccatctcctgcaggtctagtcagagcgtcctgcatagtagtggatacaactatttggattggtacctgcagaagccagggcagtctccacagctcctgatctatttggcttctaatcgggcctccggggtccctgacaggttcagtggcagtggatcagacacagattttacactgaaaatcagtagagtggaggctgaggatgttggagtttattactgcatgcaagctctacaaactcctctcactttcggcggagggaccgaaggtggagatcaaacgaactgt

SEQ ID NO: 588448 - DNA, 473 bp, Homo sapiens; identical to SEQ ID NO: 546369
  misc_feature: HIJSMM301D0Q6O.18.76.G10.1.454.light.4.raw

SEQ ID NO: 588449 - DNA, 517 bp, Homo sapiens; identical to SEQ ID NO: 580183
  misc_feature: HIJSMM301BKNJV.27.23.C01.1.454.light.4.raw

SEQ ID NO: 588450 - DNA, 523 bp, Homo sapiens
  misc_feature: HIJSMM301CWKL9.48.38.D05.1.454.light.4.raw
agtatacatacacgaccggtgctcgatttagtatctgatagttgggtttggggggtagagaagacaggattcaggacaatctccagcatggccggcttccctctcctcctcaccctcctcactcactgtgcagggtcctgggcccagtctgtgttgactcagccaccctcaacgtctgggactcccgggcagaccgtcaccatctcttgttctggcagcagatggaacatcgggagcaattttgttcactggtaccagcaactgccaggagcggcccccaaactcctcatctacaggaatgataagcgaccctcaggggtccctgcccgattctctggctccaagtctggcaccacagcctccctggccatcagaggactccggtccgaggatgagggtgatttttattgtgctgtttgggatgacgacatgaatggttcgattttcggcggagggaccaaactgaccgtcctgggtcagcccaaggctgccccctcggtcactctgttcccaccctcctcta

SEQ ID NO: 588451 - DNA, 489 bp, Homo sapiens; identical to SEQ ID NO: 543840
  misc_feature: HIJSMM301DYDKE.12.88.H11.1.454.light.4.raw

SEQ ID NO: 588452 - DNA, 497 bp, Homo sapiens
  misc_feature: HIJSMM301CCBP6.43.37.D04.1.454.light.4.raw
  modified_base (214)..(214): a, c, t, g, unknown or other
  modified_base (474)..(474): a, c, t, g, unknown or other
tgtgagtagtcacgaccggtgctcgatttagtagcatactgttgggtttggggggggaagctcagcttcagctgtgggtagagaagacaggactcaggacaatctccagcatggccagcttccctctcctcctcaccctcctcactcactgtgcagggtcctgggcccagtctgtggtgactcagccaccctcagcgtctcgggacccccgganagagggtcagcatctcctgttctggaagcagctccaacattggacgtaatactgtaaactggtaccagcaactcgcaggaacggcccccaaactcctcatctatgaccatcatcagcggccctcaggggtccctgaccgattctctggctccaagtctggctcttcagcctccctggccatcagtgggctccagtctgaggatgaggctgattattactgtgcagcgtgggatgacagcctgaatgcttgggtgttcggnggaggaccaaggtgaccgtctac

SEQ ID NO: 588453 - DNA, 504 bp, Homo sapiens; identical to SEQ ID NO: 554247
  misc_feature: HIJSMM301A5PJC.19.78.H01.1.454.light.4.raw

SEQ ID NO: 588454 - DNA, 512 bp, Homo sapiens
  misc_feature: HIJSMM301BMEOG.48.14.B03.1.454.light.4.raw
agtatacatacacgaccggtgctcgatttagtgtgagtagttccgcggggtgatcaggactcctcagttcaccttctcacaatgaggctccctgctcagctcctggggctgctaatgctctgggtcccaggatccagtggggacgttgtgttgactcagtctccactctccctgcccgtcacccttggacaatcggcctccatctcctgcacgtctagtcagagcctcgtaagtaaaaatggaaacatttacttacattggtttcaacagaggccaggccagtctccaaggcgcctgatttatgacgtttttaaacgggagtctggggtcccagacagattcagcggcagtgggtcagacactgacttcacactgagaatcagcagggttgaggctgaggatgttggcacttattactgcatgcaaggctcacactggcctccgtggacgttcggccaagggacccgggtaggaaataaaacgaaactgtggctgcaccatctgtcttcatt

SEQ ID NO: 588455 - DNA, 500 bp, Homo sapiens
  misc_feature: HIJSMM301DXLRA.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccgggtccccgaccgattcagtggcagcgggtctgggacagatttcactctcacaatcagcagcctgcagactgaagatgtgggcgtttattattgtcaacaatattctcttgttccgtttaatttcggcggagggaccaaggtggagatcaaacgaactgtggctgcaccatctgtcttcatcttcccgccat

SEQ ID NO: 588456 - DNA, 454 bp, Homo sapiens; identical to SEQ ID NO: 534964
  misc_feature: HIJSMM301DBF7N.19.86.H09.1.454.light.4.raw

SEQ ID NO: 588457 - DNA, 489 bp, Homo sapiens; identical to SEQ ID NO: 543840
  misc_feature: HIJSMM301DG1LF.12.88.H11.1.454.light.4.raw

SEQ ID NO: 588458 - DNA, 505 bp, Homo sapiens
  misc_feature: HIJSMM301EEF2N.49.82.H05.1.454.light.4.raw
  modified_base (430)..(430): a, c, t, g, unknown or other
agtcgagagacacgaccggtgctcgatttagtcgagctctctcgcggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactgaaaccagcagtgatgttgggaattataaccttttctcctggtaccaacaacacccaggcaaagcccccaaactcatcatttatgaggccgatcagcggccctcaggggtctctgatcgcttctctggctccacgtctggcagcacggcctccctgacaatctctgggctccaggctggggacgaggctgattattattgctgttcatatgccggtnatagtggccgaagggtgttcgggcggaggggaccaaggtgaccgtcctaggtcagcccaaggctgccccctcggt

SEQ ID NO: 588459 - DNA, 486 bp, Homo sapiens; identical to SEQ ID NO: 535917
  misc_feature: HIJSMM301CCW5W.3.10.A10.1.454.light.4.raw

SEQ ID NO: 588460 - DNA, 508 bp, Homo sapiens
  misc_feature: HIJSMM301DFVQG.22.46.E02.1.454.light.4.raw
acatacgcgtcacgaccggtgctcgatttagactcatctacagggaaaggggggggtcgtcaggaggcagcactctcgggacgtctccaccatggcctgggctctgctcctcctcagcctcctcactcagggcacaggatcctgggctcagtctgccctgactcagcctcgctcagtgtccgggtctcctggacagtccgtcaccatctcctgcactgggaccagcagtgatgttggtgcttataactatgtctcctggtaccagcaccacccaggcaaagccccccaactcttaatttttggtgtcaataaccgcccctcaggggtccctgatcgcttctccggctccaagtctggcaacacggcctccctgaccatctctggactccaggctgacgatgagggtgacttttactgctgctcatatgcaggcaactataatatggtcttcggcggagggaccaaagtgaccgtcctaggtcagcccaaggctgccccctggtcactc

SEQ ID NO: 588461 - DNA, 447 bp, Homo sapiens; identical to SEQ ID NO: 535020
  misc_feature: HIJSMM301EAJX3.18.9.A09.1.454.light.4.raw

SEQ ID NO: 588462 - DNA, 490 bp, Homo sapiens
  misc_feature: HIJSMM301AVFNU.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccactctgtcttcta

SEQ ID NO: 588463 - DNA, 491 bp, Homo sapiens; identical to SEQ ID NO: 535294
  misc_feature: HIJSMM301AYYGM.16.68.G02.1.454.light.4.raw

SEQ ID NO: 588464 - DNA, 521 bp, Homo sapiens; identical to SEQ ID NO: 538715
  misc_feature: HIJSMM301BO8Y3.27.23.C01.1.454.light.4.raw

SEQ ID NO: 588465 - DNA, 497 bp, Homo sapiens; identical to SEQ ID NO: 536371
  misc_feature: HIJSMM301EJ0QA.16.78.H01.1.454.light.4.raw

SEQ ID NO: 588466 - DNA, 493 bp, Homo sapiens; identical to SEQ ID NO: 538916
  misc_feature: HIJSMM301CJ3OD.27.78.H01.1.454.light.4.raw

SEQ ID NO: 588467 - DNA, 509 bp, Homo sapiens
  misc_feature: HIJSMM301BLGSM.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgtcgcaggaccgaaggtggaagtacgaaacgaactagtggcgtgcaccatactgtcttctatcttcccgccctact

SEQ ID NO: 588468 - DNA, 476 bp, Homo sapiens; identical to SEQ ID NO: 537368
  misc_feature: HIJSMM301ANBMK.7.83.H06.1.454.light.4.raw

SEQ ID NO: 588469 - DNA, 480 bp, Homo sapiens
  misc_feature: HIJSMM301AV52W.5.70.G04.1.454.light.4.raw
atcagacacgcacgaccggtgctcgatttagtgtagtgtgaagggaaaggggggagtcagacccagtcaggacacagcatggacatgagggtccccgctcagctcctggggctcctgctgctctggttcccaggttccagttgcgacatccagatgacccagtctccatcttccgtgtctgcatctgtgggagacagagtcaccatcacttgtcgggcgagtcagggtgttagcagctggttagcctggtatcagcagaaaccagggaaagcccctaagctcctgatctatgctgcatccatcttgcagagtggggtcccatcaaggttcatcggcagtggatctgggacagatttcactctcaccatcagcagcctgcagcctgaagattttgcaacttacttttgtcaacaggctcagagtttcccgctcactttcggcggagggaccaaggtggagatcaaacgaactgtggctgca

SEQ ID NO: 588470 - DNA, 487 bp, Homo sapiens; identical to SEQ ID NO: 547557
  misc_feature: HIJSMM301CPNTO.7.75.G09.1.454.light.4.raw

SEQ ID NO: 588471 - DNA, 511 bp, Homo sapiens
  misc_feature: HIJSMM301BLQQJ.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctgctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgaagattttgcagtatattactgtcagcaatatggtacttcaccccggacgttcggccaagggaccgaaggtggaagtacaaacgaactagtggctggcaccactctgtcttcactcttcccgccact

SEQ ID NO: 588472 - DNA, 516 bp, Homo sapiens; identical to SEQ ID NO: 567355
  misc_feature: HIJSMM301DAQZO.10.86.H09.1.454.light.4.raw

SEQ ID NO: 588473 - DNA, 508 bp, Homo sapiens
  misc_feature: HIJSMM301D5LIQ.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaacagtttttctcggggcgttcggccaagggaccaacggtggaaagtacaaacgaactagtggctgcaccatctgtcttcatcttccccg

SEQ ID NO: 588474 - DNA, 447 bp, Homo sapiens; identical to SEQ ID NO: 535020
  misc_feature: HIJSMM301D4UN2.18.9.A09.1.454.light.4.raw

SEQ ID NO: 588475 - DNA, 504 bp, Homo sapiens
  misc_feature: HIJSMM301B8D1X.41.55.E11.1.454.light.4.raw
tctatactatcacgaccggtgctcgatttagcactcgcacgttgggtttggggggggtcacaagaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggtaccatcagcgatgttgattattataaccttgtctcctggtaccaacaacacccaggcaaagcccccaaactcctgatttatgagggcgatcagcggccctcaggggtttctgatcgcttctctggctccaagtctggcaatacggcctccctgacagtctctcggctccaggcggaggacgaggctgattactactgcttctcatatgcagatactaagtcctgggtgttcggcggagggaccaagctgaccgtcctaggtcagcccaaggctgccccctcggt

SEQ ID NO: 588476 - DNA, 493 bp, Homo sapiens; identical to SEQ ID NO: 538753
  misc_feature: HIJSMM301D0CS3.27.78.H01.1.454.light.4.raw

SEQ ID NO: 588477 - DNA, 510 bp, Homo sapiens
  misc_feature: HIJSMM301EPV25.47.23.C01.1.454.light.4.raw
agctcacgtacacgaccggtgctcgatttagtacacgtgattagggattggggctgggcctaaggaagcagcactggtggtgcctcagccatggcctggaccgttctcctcctcggcctcctctctcactgcacagactctgtggcctcctatgtactgactcagccatcctcggtggcagtggccccaggacagacggccaggattccctgtggaggaaacaacattggaagtaagagtgtacattggtaccaacagaggccaggccaggcccctgtgctggtcgtccatgatgatagcgaccggcctcagggatccctgagcgcttctctggctccaattctgggaacacggccaccctgaccatcagcgcggtcgaagccggagatgaggccgactattactgtcaggtgtggggacaggtaatagtgatcccgagcaggttttcggcggtgggaccaagctgaccgtcctaagtcagcccaaggctgccccctcggtcactctgtt

SEQ ID NO: 588478 - DNA, 484 bp, Homo sapiens; identical to SEQ ID NO: 536162
  misc_feature: HIJSMM301DIYJJ.13.59.F04.1.454.light.4.raw

SEQ ID NO: 588479 - DNA, 491 bp, Homo sapiens
  misc_feature: HIJSMM301AQAQE.49.23.C01.1.454.light.4.raw
agtcgagagacacgaccggtgctcgatttagtacacgtgattagggaagttgggggagtcagacccagtcaggacacagcatggacatgagggtccccgctcagcctcctggggctcctgctgctctggctcccaggtgccaaatgtgacatccagatgacccagtctccttccaccctgtctgcatttgtaggagacagagtcaccatcacttgccgggccagtcagagtattagtagccggttggcctggcatcagcagaaacccgggaagcccctaagctcctgatatatgaggcgtccagtttagaaagtggggtcccatcaaggttcagcggcagtggatctgggacagagttcactctcaccatcagcagcctgcagcctgatgattttgcaacttattactgccaacagtataatagttattcgtatacttttggccaggggaccaagctggagatcaaacgaactgtggctgcaccatctgtt

SEQ ID NO: 588480 - DNA, 498 bp, Homo sapiens; identical to SEQ ID NO: 553891
  misc_feature: HIJSMM301BCVTS.3.33.C11.1.454.light.4.raw

SEQ ID NO: 588481 - DNA, 499 bp, Homo sapiens
  misc_feature: HIJSMM301AI2Y0.16.10.A10.1.454.light.4.raw
tgtactactccacgaccggtgctcgatttagcgtcgatctcagggggtgggtccaggaggcagaactctgggtgtctcaccatggcctggatccctctacttctccccctcctcactctctgcacaggctctgaggcctcctttgagttgacacagccaccctcggtgtcagtgtccccaggacagacggccaggatcacctgctcttcagatgcattgccaaggcaatatgcttcttggtaccagcagaagccaggccaggcccctgtggtggtgatatataaagacacacagaggccctcagggatccctgggcgattctctggctccagctcagggacgacagtcacgttgaccatcggtggagtccaggcagaagacgagggtgactattactgtcagtctgcaaacaccactgcagcggtgttcggcggagggaccaagctgaccgtcccgcgtcagcccaaggctgccccctcggtcactctgttcccaccct

SEQ ID NO: 588482 - DNA, 499 bp, Homo sapiens
  misc_feature: HIJSMM301AJDI0.48.30.C08.1.454.light.4.raw
agtatacatacacgaccggtgctcgatttagtctgacgtcaaagggaaagggggcatgagcaaaactgacaagtcaaggcaggaagatgttgccatcacaactcattgggtttctgctgctctgggttccagcctccaggggtgaaattgtgctgactcagtccccagactttcagtctgtgactccaaaggagaaagtcaccatcacctgccgggccagccagagcattcgtggtagtttacactggtaccagcagaaaccagatcagtctccaaagctcctcatcaagtatgcttccgagtccatctctggggtcccctcgaggttcagtggcagtggatctgggacagatttcaccctcaccatcaatagcctggaagctgaagatgctgcaacctattactgtcatcagacttttagtttacgtcggaccttcggccaaggacacgactggagattaaacgaactgtggctgcaccatctgtcttcatcttcccg

SEQ ID NO: 588483 - DNA, 520 bp, Homo sapiens; identical to SEQ ID NO: 543998
  misc_feature: HIJSMM301CCQCM.27.23.C01.1.454.light.4.raw

SEQ ID NO: 588484 - DNA, 513 bp, Homo sapiens; identical to SEQ ID NO: 548266
  misc_feature: HIJSMM301CMDH5.14.70.G04.1.454.light.4.raw

SEQ ID NO: 588485 - DNA, 494 bp, Homo sapiens; identical to SEQ ID NO: 553740
  misc_feature: HIJSMM301BH5YD.27.78.H01.1.454.light.4.raw

SEQ ID NO: 588486 - DNA, 447 bp, Homo sapiens; identical to SEQ ID NO: 535201
  misc_feature: HIJSMM301DW1UN.18.9.A09.1.454.light.4.raw

SEQ ID NO: 588487 - DNA, 471 bp, Homo sapiens; identical to SEQ ID NO: 536384
  misc_feature: HIJSMM301A24H1.18.76.G10.1.454.light.4.raw

SEQ ID NO: 588488 - DNA, 488 bp, Homo sapiens
  misc_feature: HIJSMM301BT1QD.52.23.C01.1.454.light.4.raw
cgcagtacgacacgaccggtgctcgatttagtacacgtgattagggattggggagtcccaaccaggacacagcatggacatgagggtccctgctcagctcctggggctcctgctgctctggctctcaggtgccagatgtgacatccagatgacccagtctccatcctccctgtctgcatctgtaggagacagagtcaccttcacttgccgggcgagtcaggacattagcaactatttaaattggtatcagcagaaaccagggaaagcccctaaactcctgatctacgatgcatccaatttggagacaggggtcccatcaaggttcactggaagtggatctgggacacattttactttcaccatcagcggcctgcagcctgaagattttgcaacatattactgtcaacaatatgaagatcctcccccctcactttcggcggagggaccaaggtggagatcagacgaactgtggctgcaccatctgtctt

SEQ ID NO: 588489 - DNA, 491 bp, Homo sapiens; identical to SEQ ID NO: 538388
  misc_feature: HIJSMM301D4OMD.51.81.H04.1.454.light.4.raw

SEQ ID NO: 588490 - DNA, 465 bp, Homo sapiens
  misc_feature: HIJSMM301EP62B.12.39.D06.1.454.light.4.raw
atacgacgtacacgaccggtgctcgatttagtgacatctcgcagttctttggggactgatcaggactcctcagttcaccttctcactatgaggctccctgctcagctcttggggctgctaatgctctgggtccctcgtaaggacagaaggagatgagggaggggaatggggtgagaaagatccagtgtagagattgtgatgacccagactccagtctccttgtctctcacccctggagagcaggcctccatgtcctgcaggtctagtctgcgcctcctgcatagtgacggatgctcccttttgtattggtttctgcagagaggcaggccagtctccacaactcctgatctatgaagttgccacccggctctctggagtgccagatatgttcagtggctgcgggtcaggcacagatctcacactagaaaacagccgggtggagagtgaccatgttggaacttatta

SEQ ID NO: 588491 - DNA, 497 bp, Homo sapiens
  misc_feature: HIJSMM301DL8XG.49.6.A06.1.454.light.4.raw
agtcgagagacacgaccggtgctcgatttagatctactgacaggggtggggtctcaggaggcagcgctctcaggacgtcaccaccatggcctgggctctgctcctcctcaccctcctcactcagggcacagggtcctgggcccagtctgccctgactcagccgccctccgcgtccgggtctcctggacagtctgtcaccatctcctgcactggaaccagcagtgacgttggtgattataactatgtctcctggtaccaacagtacccaggcaaagcccccagactcatgatttatgcggtcagtaagcggccctcaggggtccctgatcgcttctctggctccaagtctggcaacacggcctccctgaccgtctctgggctccgggctgaagatgaggctgattatttctgcagctcatatgcaggcagcaacaattttgtgatattcggcggagggaccaagctgaccgtcctaggtcagcccaaggctgcccccc

SEQ ID NO: 588492 - DNA, 495 bp, Homo sapiens; identical to SEQ ID NO: 538269
  misc_feature: HIJSMM301AZIZG.9.1.A01.1.454.light.4.raw

SEQ ID NO: 588493 - DNA, 454 bp, Homo sapiens; identical to SEQ ID NO: 534964
  misc_feature: HIJSMM301DD9FW.19.86.H09.1.454.light.4.raw

SEQ ID NO: 588494 - DNA, 491 bp, Homo sapiens
  misc_feature: HIJSMM301EUGKT.48.53.E09.1.454.light.4.raw
agtatacatacacgaccggtgctcgatttagagagagtgtgttgggtttgggggtgggtccaggaggcagaactctgggtgtctcaccatggcctggatccctctacttctccccctcctcattctctgcacaggctctgaggcctcctatgaactgacacagccaccctcggtgtcagtgtccccaggacagacggccaggatcacgtgctctgcagagacgttgccaagtcaatttggtttttggtatcagcagaagtcaggccaggccccaagactgctcatgtatagagacagtgagaggtcctcagggatccctgagcgattctctggctccagctctgggacgacactcactctgactatcagtgaagtccgggcagaagacgaggctgactactattgtcagtcaggagacaatactcgcacgcaagtactgttcggcggagggaccaagctgacagtcctaggtcagcccaaggctgcccccc

SEQ ID NO: 588495 - DNA, 496 bp, Homo sapiens; identical to SEQ ID NO: 558251
  misc_feature: HIJSMM301CIBO4.16.78.H01.1.454.light.4.raw

SEQ ID NO: 588496 - DNA, 486 bp, Homo sapiens; identical to SEQ ID NO: 536323
  misc_feature: HIJSMM301BKYO0.10.2.A02.1.454.light.4.raw

SEQ ID NO: 588497 - DNA, 517 bp, Homo sapiens
  misc_feature: HIJSMM301EIPQY.13.38.D05.1.454.light.4.raw
tcacgtactacacgaccggtgctcgatttagtatctgatagttgggtttgggggagtcagtctcagtcaggacacagcatggacatgagggtccccgctcagctcctggggctcctgctactctggctccgaggtgccagatgtgacatccagatgagccagtctccatccaccctgtctgcgtctctcggagacagggtcaccatcacttgtcgggcaagtcagaacattggcaactctttaaattggtatcagcagaagtcagggcaagccccgaacctcctgatctacggtacatccactttgcacagtgggatcccatcaaggttcagtggcagtagatctggaacagatttttaccctcaccatcaggggtctacagcctgaagattttgcgacttactattgtcaacagagttaccttctcccccggacgtcggtccacggaccgaacggtaggaagtacgtaagcgaacgtacgtggcgtggcaccactactgtcttctactcttcccgt

SEQ ID NO: 588498 - DNA, 484 bp, Homo sapiens; identical to SEQ ID NO: 536162
  misc_feature: HIJSMM301C6I0N.13.59.F04.1.454.light.4.raw

SEQ ID NO: 588499 - DNA, 509 bp, Homo sapiens
  misc_feature: HIJSMM301BLH8J.9.12.B01.1.454.light.4.raw
tgatacgtctcacgaccggtgctcgatttagtagtgtagattccgcggggacgaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggccaacgggaccaaggtaggaaatacaaacgaactagtggctgcaccatctgtcttcactcttccccg

SEQ ID NO: 588500 - DNA, 501 bp, Homo sapiens
  misc_feature: HIJSMM301A9E22.3.53.E09.1.454.light.4.raw
agacgcactccacgaccggtgctcgatttagagagagtgtgttgggtttgggggagctacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacagctccaacaaaaagaactacttaggttggtaccagcagaaaccagggcagcctcctaagctgctcattacctgggcatctacccgggaatctggggtccctgaccgattcagtggcagcgggtctgggacagatttcactctcaccatcaccaacctgcaggctgaagatgtggccgtttattactgtcagcaatattatggtactcctccgtggacgttcgccaaggacaaggtggaaatcaaacgaactgtggctgcaccat

SEQ ID NO: 588501 - DNA, 501 bp, Homo sapiens; identical to SEQ ID NO: 550139
  misc_feature: HIJSMM301A72GZ.15.56.F01.1.454.light.4.raw

SEQ ID NO: 588502 - DNA, 513 bp, Homo sapiens
  misc_feature: HIJSMM301BGTIF.48.3.A03.1.454.light.4.raw
agtatacatacacgaccggtgctcgatttagagagcgtcacagagagaaaggggctgggcctcaggaagcagcatcgggggtgccgcagccatggcctggaccgctctccttctgagcctccttgctcactttacagattctgtggcctcctatgaattgactcagcccttctcagtgtcggtggccctggggcagacggccaggatgacctgtgggggaaacaaaattggaagtaaagatgtgcactggtatcagcacaagccaggccaggcccctctactggtcatttatagggataccaatcggccctctgggatccctgagcggatctctggctccaactcggggaacacggccaccctgaccatcagcggggcccaagccggggatgaggctgactatttctgtcaggtgtgggacagcagcagtgtgattttcggcggcgggaccaagctgaccgtcctaggtcagcccaaggctgccccctcggtcactctcgttcccaccctcct

SEQ ID NO: 588503 - DNA, 520 bp, Homo sapiens
  misc_feature: HIJSMM301DUAG3.7.87.H10.1.454.light.4.raw
cgtgtctctacacgaccggtgctcgatttagcagtactgcgttgggtttgggggagctgctcagttaggacccagagggaaccatggaaaccccagcgcagcttctcttcctcctcctactctggctcccagataccaccggagaaactgtgttgacacagtctccaggcaccctgtctttgtctccgggggaaagagccaccctctcctgcagggccagtcagagtgttagcatatatttagcctggtaccaacagaaacctggccaggctcccaggctcctcatcaaaggtgcatccacaagggccactggcatcccagacaggttcagtggccgtgggtctgggacagagttcagtctcaccatcagcagactggagcctgagatttgcagtatattactgtcagcaatatggtacttcacccggacgtcgcacggacgaacggtaggaaggtacgaacgaactagtaggctgcgaccactctcgtcttctacttcttcccgtccctactcctgtat

SEQ ID NO: 588504 - DNA, 529 bp, Homo sapiens
  misc_feature: HIJSMM301E4BT7.4.39.D06.1.454.light.4.raw
agcactgtagcacgaccggtgctcgatttagtgacatctcgcagttctttggggggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcaccatctcctgcactggaaccagcagtgacgttggtcgttataactatgtctcctggtaccaacaacacccaggcaaagcccccaaattcataatttatgaggtcactaagcggccctcaggggtccctgatcgcttctctgcctccaaggctggcaacacggcctccctgaccgtctctgggctccaggctgaggatgaggctgattattattgtcagctcatatgcaggcagttacaatagtgatattcggtcgggaggggacccgaaacctacgaccggtcccttacggtactagacccccaacggcgtcgccccccgtcccc

SEQ ID NO: 588505 - DNA, 498 bp, Homo sapiens
  misc_feature: HIJSMM301AWGLR.15.81.H04.1.454.light.4.raw
tctacgtagccacgaccggtgctcgatttagtagtgtagattcgcggggggggtctcaggaggcagcgctctcaggacatctccaccatggcctgggctctgctgctcctcaccctcctcactcagggcacagggtcctgggcccagtctgccctgactcagcctgcctccgtgtctgggtctcctggacagtcgatcatcatcttctgcactggatccagcagtgacgttggtagttataattatgtctcctggtaccaacagtacccaggcaaagcccccaaactcatgatttatgaggtcagtaatcggccctcaggggtttctaatcgcttctctggctccaagtctggcaacacggcctccctgaccatctctgggctccaggctgaggacgagggtgattattactgcagctcatatagaagtggcagcactctcgtattcggcggtgggaccaagctgaccgtcctaggtcagcccaaggctcgccccctc

SEQ ID NO: 588506 - DNA, 485 bp, Homo sapiens; identical to SEQ ID NO: 546273
  misc_feature: HIJSMM301DM1B1.43.36.D03.1.454.light.4.raw

SEQ ID NO: 588507 - DNA, 501 bp, Homo sapiens; identical to SEQ ID NO: 535746
  misc_feature: HIJSMM301AGOQP.18.11.A11.1.454.light.4.raw

SEQ ID NO: 588508 - DNA, 505 bp, Homo sapiens; identical to SEQ ID NO: 536254
  misc_feature: HIJSMM301AQOEQ.7.71.G05.1.454.light.4.raw

SEQ ID NO: 588509 - DNA, 485 bp, Homo sapiens; identical to SEQ ID NO: 539315
  misc_feature: HIJSMM301AVQZE.3.88.H11.1.454.light.4.raw

SEQ ID NO: 588510 - DNA, 503 bp, Homo sapiens; identical to SEQ ID NO: 550542
  misc_feature: HIJSMM301CXQTX.2.76.G10.1.454.light.4.raw

SEQ ID NO: 588511 - DNA, 488 bp, Homo sapiens; identical to SEQ ID NO: 537124
  misc_feature: HIJSMM301BH512.11.25.C03.1.454.light.4.raw

SEQ ID NO: 588512 - DNA, 486 bp, Homo sapiens; identical to SEQ ID NO: 535917
  misc_feature: HIJSMM301C3FIN.3.10.A10.1.454.light.4.raw

SEQ ID NO: 588513 - DNA, 501 bp, Homo sapiens; identical to SEQ ID NO: 543562
  misc_feature: HIJSMM301C1QHP.10.71.G05.1.454.light.4.raw

SEQ ID NO: 588514 - DNA, 482 bp, Homo sapiens; identical to SEQ ID NO: 540521
  misc_feature: HIJSMM301AJUYS.21.25.C03.1.454.light.4.raw

SEQ ID NO: 588515 - DNA, 520 bp, Homo sapiens
  misc_feature: HIJSMM301D23UC.17.33.C11.1.454.light.4.raw
cgtagactagcacgaccggtgctcgatttagagtgagctcgttgggtttggggggcgccaggggtcccttccaatatcagcaccatggcctggactcctctctttctgttcctcctcacttgctgcccagggtccaattctcagactgtggtgactcaggagccctcactgactgtgtccccaggagggacagtcactctcacctgtgcttccaacactggggcagtcaccagtgcttactatccaaactggttccagcagaaacctggacaagcacccagggcactcatttatagtacaaacaacaaacactcctggacccctgcccgattctcaggctccctccttgggggcaaagctgccctgacactgtctggtgtgcagcctgaggacgaggctgactattactgcctactctactttggtggtgctgtgctattcggcggagggaccaagctgaccgtcttaagtcagcccaaggctgccccctcggtcactctgttcccaccctcctcctacg

SEQ ID NO: 588516 - DNA, 487 bp, Homo sapiens
  misc_feature: HIJSMM301BKN8X.14.53.E09.1.454.light.4.raw
cgtctagtaccacgaccggtgctcgatttagagagagtgtgtgggtccaggaggcagaactctgggtgtctcaccatggcctggatccctctacttctcctcctcctcactctctgcacaggctctcaggcctcctatgagctgacacagccaccctcggtgtcagtgtccccaggacagacggccaggatcacctgctctggagatttgttgacaaagcagtatgctttttggtaccagcagaagccaggccaggcccctctcttgattatatataaggacactgagaggccctcagggatccctgagcgattctctggctccagctcagggacaacactcaccttgaccatcagtgcagtccaggcagaagacgaggctgactattattgtcaatcagcagtcagcactaattcttatcgggtgttcggcggagggaccaagctgaccgtcctaggtcagcccaaggctgccccctcggtctacc

SEQ ID NO: 588517 - DNA, 505 bp, Homo sapiens; identical to SEQ ID NO: 535503
  misc_feature: HIJSMM301AM3B1.8.28.C06.1.454.light.4.raw

SEQ ID NO: 588518 - DNA, 490 bp, Homo sapiens
  misc_feature: HIJSMM301DDOQ8.14.55.E11.1.454.light.4.raw
cgtctagtaccacgaccggtgctcgatttagcactcgcacgttgggtttggggagtctcagtcaggacacagcatggacatgagggtccccgctcagctcctggggctcctgctactctggctccgaggtgccagatgtgacatccagatgacccagtctccatcctccctgtctgcatctgtaggagacagagtcaccatcacttgccgggcaagtcagagcattaagaactatttaaattggtatcaaacagaaaccagggaaagcccctgacctcctgatctatgctgcatccagtttgcacagtggggtcccgtcaaggttcagtggcagtggatctgggacagatttcactctcaccgtcagcagtctgcaacctgaagattttgcaacttactactgtcaacagagttacagtacccccctcactttcggcggagggaccaaggcggagatcagacgaactgtggctgcaccatctgtcttcta

SEQ ID NO: 588519 - DNA, 521 bp, Homo sapiens; identical to SEQ ID NO: 539470
  misc_feature: HIJSMM301BN5KO.27.23.C01.1.454.light.4.raw

SEQ ID NO: 588520 - DNA, 491 bp, Homo sapiens; identical to SEQ ID NO: 535176
  misc_feature: HIJSMM301EVV99.13.39.D06.1.454.light.4.raw

SEQ ID NO: 588521 - DNA, 509 bp, Homo sapiens; identical to SEQ ID NO: 539359
  misc_feature: HIJSMM301A5WIC.47.85.H08.1.454.light.4.raw

SEQ ID NO: 588522 - DNA, 488 bp, Homo sapiens
  misc_feature: HIJSMM301EBBB1.3.10.A10.1.454.light.4.raw
agacgcactccacgaccggtgctcgatttagcgtcgatctcagggggtgggtccaggaggcagaactctgggtgtctcaccatggcctggatccctctacttctccccctcctcactctctgcacagactctgaggcctcctatgagctgacacagccaccctcggtgtcagtgtccccaggacagacggccaagatcacctgctctggagatgcattgccaaagcaatatgcttattggtaccaacaaaagccaggccaggcccctgtggtggtgatatataaagacagtgagaggccctcagggatccctgagcgattctctggctccagctcagggacaacagtcacgttgaccatcagtggagtccaggcagaggacgaggctgactattattgtcaatcagcagacaacagtaatacttatctttatgtcttcggatctgggaccagggtcaccgtcctaggtcagcccaaggccaaccccca

SEQ ID NO: 588523 - DNA, 491 bp, Homo sapiens; identical to SEQ ID NO: 563114
  misc_feature: HIJSMM301AVCCS.40.57.F02.1.454.light.4.raw

SEQ ID NO: 588524 - DNA, 377 bp, Homo sapiens; identical to SEQ ID NO: 536071
  misc_feature: HIJSMM301D5IDD.40.9.A09.1.454.light.4.raw

SEQ ID NO: 588525 - DNA, 502 bp, Homo sapiens
  misc_feature: HIJSMM301BOYN5.5.24.C02.1.454.light.4.raw
atcagacacgcacgaccggtgctcgatttagtacagatcgttagggaaaggggggggtctcaggaggcagcgctctcaggacgtcaccaccatggcctgggctctgctcctcctcaccctcctcactcagggcacagggtcctgggcccaggctgccctgactcagcctccctccgcatccgggtctcctggacagtcagtcaccatctcctgcactgcaaccagcagtgacgttggtggttcgaagtatgtctcctggtaccaacaacaccccgacaaagcccccaaactcatcatttttgaggtcactacgcgaccctcaggggtccctgatcgcttctctggctccaagtctggcaacacggcctccctgaccgtctctgggctccaggctgaggatgaggctgattattactgcagctcatatgcaggcagcagcagtccccatgtgatcttcggcggggggaccaagctgaccgtcctaggtcagcccaaggctccg

SEQ ID NO: 588526 - DNA, 480 bp, Homo sapiens; identical to SEQ ID NO: 535630
  misc_feature: HIJSMM301BRPGU.40.59.F04.1.454.light.4.raw

SEQ ID NO: 588527 - DNA, 440 bp, Homo sapiens
  misc_feature: HIJSMM301CXSHR.11.3.A03.1.454.light.4.raw
cgagagataccacgaccggtgctcgatttagagagcgtcacagggtcctgggcccagtctgtgctgacgcagccgccctcagtgtctggggccccagggcagacggtcaccatctcctgcactggaaacagctccaacgtcggggcaggttatgatgttcactggtaccagcaccttccacaaacagcccccaaactcctcatatatggtaacagcattcggccctcaggggtccctgaccgattctctggttccttgtctgacacctcagcccccctggccatcactgggctccagcctgaggatgaggctgattattactgtcagtcctttgacattaaactggatgtggtattcggcggagggacccacgtaaccgtcctaggtcagcccaaggctgccccctcggtcactctgttcccacctcctcgtatctctcg

SEQ ID NO: 588528 - DNA, 444 bp, Homo sapiens; identical to SEQ ID NO: 541457
  misc_feature: HIJSMM301D3XO0.7.18.B07.1.454.light.4.raw

SEQ ID NO: 588529 - DNA, 494 bp, Homo sapiens
  misc_feature: HIJSMM301BK2LT.49.48.E04.1.454.light.4.raw
agtcgagagacacgaccggtgctcgatttagagagcgtcacagagagaagggggaggaactgctcagttaggacccagagggaaccatggaagccccagctcagcttctcttcctcctgctactctggctcccagataccaccggagaaattgtgttgacacagtctccagtcaccctgtctatgtctccaggggaaagagccaccctctcctgcagggccagtcagaatgttggcagctacttagcctggtaccagcagaaacctggccaggctcccagtctcctcatctttgatgcatcccgcagggccgctgacatcccagccagggttccagtggcagtgggtttgggacaggacttcacgctcaccatcagcagcctagagcctgaagattttgcagtttattactgtcaacagcgtaccacaggattcactttcggccctgggaccagagtggatatcaaacgaactagtggctgcaccatctgtctt

SEQ ID NO: 588530 - DNA, 497 bp, Homo sapiens; identical to SEQ ID NO: 546748
  misc_feature: HIJSMM301AYSZ6.43.37.D04.1.454.light.4.raw

SEQ ID NO: 588531 - DNA, 454 bp, Homo sapiens; identical to SEQ ID NO: 535005
  misc_feature: HIJSMM301ESF4L.19.86.H09.1.454.light.4.raw

SEQ ID NO: 588532 - DNA, 498 bp, Homo sapiens
  misc_feature: HIJSMM301DVFHW.40.57.F02.1.454.light.4.raw
tctagcgactcacgaccggtgctcgatttagctcgatatagttgggtttgggggggtctcaggaggcagcactctcgggacgtctccaccatggcctgggctctgctcctcctcagcctcctcactcagggcacaggatcctgggctcactctaccctgactcagcctcgctcagtgtccgggtctcctggacagtcagtcaccatctcctgcactggaaccagcagtgatattggtgcttataactctgtctcctggtaccaacaacacccgggcaaaggtcccaaacttctgatttatgatgtcactaagcggccctcaggggtcgctgatcgcttctctggctccaagtctggcgacacggcctcccctgaccatctctgggctccagactgaggatgaggctacttattttgctgctcttatgcaggcagtttcgctctcgaagtgttcggcggagggaccgaggctgaccgtcctacgtcagcccaaggctcg

SEQ ID NO: 588533 - DNA, 481 bp, Homo sapiens
  misc_feature: HIJSMM301DVP2F.49.81.H04.1.454.light.4.raw
agtcgagagacacgaccggtgctcgatttagtagtgtagattcgcgggaggagtcagtcccaaccaggacacagcatggacatgagggtccctgctcagctcctggggctcctgctgctctggctctcaggtgccagatgtgacatccggatgacccagtctccatcctccctgtctgcatctgtaggagacagaatcaccatcacttgccaggcgactcaggacattagcaactatttaaattggtatcagcagaaaccagggaaagcccctaacctcctgatctacgatgcatccaatttggaaataggggtcccatcaaggttcagtggaagtggatctgggacgtattttactttcaccatcatcaacctgcagcctgaggatattgcaacatattactgtcaacaatatgataatctaccactcactttcggcggagggaccacggtggagatcaaacgaactgtggctgcaccat

SEQ ID NO: 588534 - DNA, 504 bp, Homo sapiens
  misc_feature: HIJSMM301A6F9T.10.71.G05.1.454.light.4.raw
catagtagtgcacgaccggtgctcgatttagtgtcgtcgcaagagagaggggggggaggaactgctcagttaggacccagagggaaccatggaagcccagctcagcttctcttcctcctgctactctggctcccagacaccaccggagaaattgtgttgacacagtctccagccacgctgtctttgtctccaggggaaagagccaccctctcctgcagggccagtcagagtgttcgcacttcgttagggtggtatcaacataaatccggccaggctcccaggctcctcatctttgatgctttcaacagggcccctggcgtcccaggcaggttcagtggcagtgggtctgggacagacttcactctcaccatcagcagcctagagcctgaagattttgcagtttattactgtcagcagcgtgccactttcggcggaggtgccactttcggcggagggaccgaaaatagaggtacaaacgaaactgtggctgcacactctgtcttc

SEQ ID NO: 588535 - DNA, 502 bp, Homo sapiens
  misc_feature: HIJSMM301CBEA7.11.31.C09.1.454.light.4.raw
cgagagataccacgaccggtgctcgatttagacgtctcatcaaggaaggaaggggcagcaagatggtgttgcagacccaggtcttcatttctctgttgctctggatctctggtgccaacggggacatcgtgatgacccagtctccagacttcctatttgtatctctgggcgagagggccaccatcaactgcaaggcaagccagattattttatacagctccgacagtaagaactacttatcttggttccaacagaaaccaggacagcctcctaaattactcatttattccacatctatgcgggcctccggggtccccgaccgattcagtggcagcggatctgggacagatttcactctcacaatcagcagcctgcagactgaagatgtgggcgtttattattgtcaacaatattctcttgttccgtttaatttcggcggtagggaccaaggtggagatcaaacgaactgtggccgcaccatctgtcttcatcttcccgccat

SEQ ID NO: 588536 - DNA, 486 bp, Homo sapiens
  misc_feature: HIJSMM301CIOSR.40.83.H06.1.454.light.4.raw
tctagcgactcacgaccggtgctcgatttagatcacgtgcgtcgcggggcaaaaacagagcttcagcaagcatagtgggaatctgcaccatgccctgggctctgctcctcctgaccctcctcactcactctgcagtgtcagtggtccaggcagggctgactcagccaccctcggtgtccaaggacttgggacagaccgccacactcacctgcactgggaacagcgacaatgttggcgcccaaggagcagcttggctgcagcagtaccagggccgccctcccaaactcctctcccacaggtctggcgaccggccctcagggatctcagagagatattctgcatccaggttcgcgaacacagcctccctgaccatcactggactcaagcctgaggacgaggctgactattactgttcagcatggacggcagcctcagtgaatgggtgttcggcggagggaccaaactgtccgtcctaggtcagacccg

SEQ ID NO: 588537 - DNA, 487 bp, Homo sapiens; identical to SEQ ID NO: 536206
  misc_feature: HIJSMM301CHSMI.47.38.D05.1.454.light.4.raw

SEQ ID NO: 588538 - DNA, 496 bp, Homo sapiens
  misc_feature: HIJSMM301EIRQK.13.6.A06.1.454.light.4.raw
tcacgtactacacgaccggtgctcgatttagatctactgacaggggaggactcctcagttcaccttctcacaatgaggctccctgctcagctcctggggctgctaatgctctgggtctccggatccagtgggaatattgtgatgactcagtctccactctacctgcccgtcacccctggagagccggcctccatctcctgcaggtccagtcagagcctcctgcatagaaatggatataactatttggattggtatctgcagaggccagggcagtccccacaactcctgatctattggggttctaatcgggcctccggggtccctaacaggttcagtggcagtggatcaggcacagattttacactgaaaatcagcagagtggaggctgaggatgttggggtttattactgcatgcaagctctacaacctctgcggactttcggccctggaccgaaagtggaggatcaaacgaaactgtggctgcaccatctgtctt

SEQ ID NO: 588539 - DNA, 454 bp, Homo sapiens; identical to SEQ ID NO: 535005
  misc_feature: HIJSMM301CCM0G.19.86.H09.1.454.light.4.raw

SEQ ID NO: 588540 - DNA, 494 bp, Homo sapiens
  misc_feature: HIJSMM301EB7ZZ.49.68.G02.1.454.light.4.raw
agtcgagagacacgaccggtgctcgatttagtcgatagtgaagggaaagggggggaggaactgctcagttaggacccagagggaaccatggaagccccagctcagcttctcttcctcctgctactctggctcccagataccaccggagaaattgtgttgacacagtctccggccaccctgtctttgtctccaggggacagtgccaccctctcctgcagggccagtcagagtgttagtagcttcttagcctggtaccaacagaaacctggccaggctcccaggctcctcatctatgatgcatccaacagggccactggcatcccagccaggttcagtggcagtgggtctgtgacagacttcactctcaccatcagcagcctagagcctgaagattctgcagtttattactgtcagcagcgtagcaactggcctctcactttcggcggagggaccaaggtggagatcaaacgaactgtggctgcaccatctgtctt

SEQ ID NO: 588541 - DNA, 491 bp, Homo sapiens
  misc_feature: HIJSMM301EQKTF.46.35.D02.1.454.light.4.raw
actagcagtacacgaccggtgctcgatttagcacacgatagttggggtttgggggaggctgctcagttaggacccagaggggaaccatggaaaccccagcgcagcttctcttcctcctgctactctggctcccagaaaccaccggagaagttgtgttgacgcagtctccaggcaccctgtctttgtctccaggggaaagagccaccctctcctgcagggccagtcactatgttagtgacaactacttagcctggttgcagtcacaaacctggccaggctcccaggctcctcatctatgctgcatccatcagggccactggcatcccaggcagattcagtggcagtgggtctggggacagacttcactctcaccatcagcagactggagcctgaagattttgcagtctattactgtcagcagtatggtcacgtcccaagaacttttggccgagggaccaagctggagatcaaacgaactgtggctgcaccat

SEQ ID NO: 588542 - DNA, 508 bp, Homo sapiens; identical to SEQ ID NO: 540640
  misc_feature: HIJSMM301AJ6UQ.5.60.F05.1.454.light.4.raw

SEQ ID NO: 588543 - DNA, 490 bp, Homo sapiens
  misc_feature: HIJSMM301BWXI1.19.71.G05.1.454.light.4.raw
tactctcgtgcacgaccggtgctcgatttagtgtcgtcgcaagagagaggggggaggtacaacaggcaggcaggggcagcaagatggtgttgcagacccaggtcttcatttctctgttgctctggatctctggtgcccacggggacatcgtgatgacccagtctccagactccctggctgtgtctctgggcgagcgggccaccatcaactgcaagtccagccacaatcttttatacagttccaacaatgaaaactacttagcttggtaccagcagagaccaggacagcctcctaggctgctcatttactgggcatctacccgggaatccggggtccctgaccgattcagtggcagcgggtctgggacagatttcactctcaccatcagcagcctgcaggctgaagatgtggcagtttattattgtcaacaatattattatacttcgtggacgttcggtccaagggaccgaaggtaggagtatcagacgaa

SEQ ID NO: 588544 - DNA, 516 bp, Homo sapiens
  misc_feature: HIJSMM301C364N.9.12.B01.1.454.light.4.raw
tgatacgtctcacgaccggtgctcgatttagtagtgtagattccgcggggacaacaggcaggcaggggcagcaagatggtgttgcagacccaggtcttcatttctctgttgctctggatctctggtgcctacggggacatcgtgatgacccagtctccagactccctggctgtgtctctgggcgagagggccaccatcaactgcaagtccagccagagtgttttatacggctccgacaacaagaactacttagcttggtatcagcagaaaccaggacagcctcctaaactgctcattaactgggcatctacccggcaatccggggtccctgaccgattcagtggcagcgggtctgggacagatttcactctcaccatcagcagcctgcaggctgaagatgtggcagtttattactgtcaactagttttctcgggcgttcggtccgaacgggaccgaagggtaggaaagtacgaaaacgaacctagtggctgcaccatctgtcttctatcttccccg

SEQ ID NO: 588545 - DNA, 483 bp, Homo sapiens; identical to SEQ ID NO: 535413
  misc_feature: HIJSMM301BAFXV.26.78.H01.1.454.light.4.raw

SEQ ID NO: 588546 - DNA, 508 bp, Homo sapiens
  misc_feature: HIJSMM301DTZUX.40.48.E04.1.454.light.4.raw
tctagcgactcacgaccggtgctcgatttagagagcgtcacagagagaaggggtggggtctcaggaggcagcgctctcaggacgtcaccaccatggcctgggctctgctcctcctcaccctcctcactcagggcacagggtcctgggcccagtctgccctgactcagcctccctccgcgtccgggtctcctggacagtcagtcgccatctcctgcactggaaccaataatgacgttggtggttacaactatgtctcctggtaccaacaatacccaggcaaagcccccaaactcctgatttatgaggtcagtaagcggccctcaggggtccctgatcgcttctctggctccaagtctgtcaacacggcctccctgaccgtctctgggctccaggctgaggatgaggctgtttactactgcagctcatatgcaggcagcaataatttggtgttcggcgggggaccaagctgaccgtcctaggtcagcccaaggctgccccctcggtcact

SEQ ID NO: 588547 - DNA, 497 bp, Homo sapiens; identical to SEQ ID NO: 536371
  misc_feature: HIJSMM301A3AE8.16.78.H01.1.454.light.4.raw

SEQ ID NO: 588548 - DNA, 481 bp, Homo sapiens; identical to SEQ ID NO: 539712
  misc_feature: HIJSMM301CJD2E.51.60.F05.1.454.light.4.raw

SEQ ID NO: 588549 - DNA, 488 bp, Homo sapiens; identical to SEQ ID NO: 535990
  misc_feature: HIJSMM301CPR0O.11.28.C06.1.454.light.4.raw

SEQ ID NO: 588550 - DNA, 466 bp, Homo sapiens; identical to SEQ ID NO: 535366
  misc_feature: HIJSMM301EC7M0.13.4.A04.1.454.light.4.raw

SEQ ID NO: 588551 - DNA, 519 bp, Homo sapiens
  misc_feature: HIJSMM301D5WCH.27.23.C01.1.454.light.4.raw
agcgtcgtctcacgaccggtgctcgatttagtacacgtgattagggattggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaacccgcgatgacgttggtgcttataactttatctgttggtaccgacaggacccaggcactgtccccaaactcattctttatgatgtcagtaatcggcccccaggggtttctgatcgcttctatggctccaagtctgcctacacggcctccctgaccatctccgggctccagcctgaggacgaggctgattattattgtagttcatatacaaccagtgacacttgggtgttcggcggagggaccaggctgacgtcctaggtcagcccaaggctgccccctcggtcactctgttcccacct

SEQ ID NO: 588552 - DNA, 460 bp, Homo sapiens; identical to SEQ ID NO: 537107
  misc_feature: HIJSMM301CWZ4X.22.28.C06.1.454.light.4.raw

SEQ ID NO: 588553 - DNA, 505 bp, Homo sapiens; identical to SEQ ID NO: 535503
  misc_feature: HIJSMM301A8LQ5.8.28.C06.1.454.light.4.raw

SEQ ID NO: 588554 - DNA, 499 bp, Homo sapiens; identical to SEQ ID NO: 587698
  misc_feature: HIJSMM301C3V4A.48.59.F04.1.454.light.4.raw

SEQ ID NO: 588555 - DNA, 517 bp, Homo sapiens
  misc_feature: HIJSMM301EOKBQ.41.78.H01.1.454.light.4.raw
tctatactatcacgaccggtgctcgatttagtgtgagtagtttgggtttgggggatagctcaggaagcagagcctggagcatctccactatggcctgggctccactacttctcaccctcctcgctcactgcacaggttcttgggcccattttatattgacacagccccactctgtgtcggagtcttcggggaagacggtaaccctgtcctgcacccgcagcagcggcagcattggcagcagctatgtgcagtggttccagcagcgcccgggcagttctcccgtcactctaatttatgaagattttcgaagactccctggggtcccctttcggttttctggctccatcgacagtccctccaactccgcctcccttaccatatctgggctgaagagtgaggacgaggctgactacttctgtcagtcttatgatataaacaattatgtgataattggcggagggaccagggtgaccgtctaggtcagcccaaggctgccccctcggtcactctgttccca

SEQ ID NO: 588556 - DNA, 471 bp, Homo sapiens; identical to SEQ ID NO: 575307
  misc_feature: HIJSMM301BDIVM.18.76.G10.1.454.light.4.raw
